United States Patent 9,254,311 (MODIFIED POLYNUCLEOTIDES FOR THE PRODUCTION OF PROTEINS) - sequence listing, part 9

SEQ ID NO: 12992 - protein, 986 aa, Homo sapiens
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 12993 - protein, 435 aa, Homo sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 12994 - protein, 435 aa, Homo sapiens; identical to SEQ ID NO: 12993

SEQ ID NO: 12995 - protein, 473 aa, Homo sapiens
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 12996 - protein, 473 aa, Homo sapiens; identical to SEQ ID NO: 12995

SEQ ID NO: 12997 - protein, 387 aa, Homo sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 12998 - protein, 203 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRVSARSREGRGGRPGSTRPHRSACSSAAVRGHPRALPPDARPHRRPHELLPVGGRLPGPTRPVLGRRAVGGRLRLVPGGQRPADVPEPGRAGYPAPRDEGVLRPRAHA

SEQ ID NO: 12999 - protein, 282 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKKRDEDDVPTVPSTLGEERLYNPFLRVAEEPVRKFTGKAVPADVLEALCKERARFEQAGEPRQPQARALLALQWGLLSAAPHD

SEQ ID NO: 13000 - protein, 202 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGTRSAERAHPASRRPRPICSDPPSPARRRAVGGRLRLVPGGQRPADVPEPGRAGYPAPRDEGVLRPRAHA

SEQ ID NO: 13001 - protein, 168 aa, Homo sapiens [sequence omitted]

SEQ ID NO: 13002 - protein, 387 aa, Homo sapiens
MNRHHLQDHFLEIDKKNCCVFRDDFIAKVLPPVLGLEFIFGLLGNGLALWIFCFHLKSWKSSRIFLFNLAVADFLLIICLPFVMDYYVRRSDWKFGDIPCRLVLFMFAMNRQGSIIFLTVVAVDRYFRVVHPHHALNKISNWTAAIISCLLWGITVGLTVHLLKKKLLIQNGTANVCISFSICHTFRWHEAMFLLEFFLPLGIILFCSARIIWSLRQRQMDRHAKIKRAITFIMVVAIVFVICFLPSVVVRIHIFWLLHTSGTQNCEVYRSVDLAFFITLSFTYMNSMLDPVVYYFSSPSFPNFFSTLINRCLQRKITGEPDNNRSTSVELTGDPNKTRGAPEALIANSGEPWSPSYLGPTSNNHSKKGHCHQEPASLEKQLGCCIE

SEQ ID NO: 13003 - protein, 321 aa, Homo sapiens
MSGNGNAAATAEENSPKMRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 13004 - protein, 344 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 13005 - protein, 304 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 13006 - protein, 277 aa, Homo sapiens
MAPLRFSANLSWLFPELSGLPARVRAAGSSGFEAVEVAWPYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 13007 - protein, 229 aa, Homo sapiens
MGLGAVPGRQAAFREGLEQAVRSGHCLMGRKLSVPCKGAVARGGLVYLAAFLRLDMIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 13008 - protein, 204 aa, Homo sapiens
MGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 13009 - protein, 247 aa, Homo sapiens
MAPLRFSANLSWLFPELSGLPARVRAAGSSGFEAVEVAWPYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 13010 - protein, 302 aa, Homo sapiens
MAPLRFSANLSWLFPELSGLPARVRAAGSSGFEAVEVAWPYAETPEALARAAREAGLRLVLINTPPGDQEKGEMGLGAVPGRQAAFREGLEQAVRSGHCLMGRKLSVPCKGAVARGGLVYLAAFLRLDMIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 13011 - protein, 53 aa, Homo sapiens
MCSYYHMKKRSVSGCNITIFAVMFSHLSAGKSPCGNQANVLCISRLEFVQYQS

SEQ ID NO: 13012 - protein, 336 aa, Homo sapiens
MPPPAPGARLRLLAAAALAGLAVISRGLLSQSLEFNSPADNYTVCEGDNATLSCFIDEHVTRVAWLNRSNILYAGNDRWTSDPRVRLLINTPEEFSILITEVGLGDEGLYTCSFQTRHQPYTTQVYLIVHVPARIVNISSPVTVNEGGNVNLLCLAVGRPEPTVTWRQLRDGFTSEGEILEISDIQRGQAGEYECVTHNGVNSAPDSRRVLVTVNYPPTITDVTSARTALGRAALLRCEAMAVPPADFQWYKDDRLLSSGTAEGLKVQTERTRSMLLFANVSARHYGNYTCRAANRLGASSASMRLLRPGSLENSAPRPPGLLALLSALGWLWWRM

SEQ ID NO: 13013 - protein, 404 aa, Homo sapiens
MECALDAQSLISISLRKIHSSRTQRGGIKLHKNLLVSYVLRNARQLYLSERYAELYRRQQQQQQQQPPHHQHQHLAYAAPGMPASAADFGPLQLGGGGDAEAREPAARHQLHQLHQLHQLHLQQQLHQHQHPAPRGCAAAAAAGAPAGGAGALSELPGCAALQPPHGAPHRGQPLEPLQPGPAPLPLPLPPPAPAALCPRDPRAPAACSAPPGAAPPAAAASPPASPAPASSPGFYRGAYPTPSDFGLHCSSQTTVLDLDTHVVTTVENGYLHQDCCASAHCPCCGQGAPGPGLASAAGCKRKYYPGQEEEEDDEEDAGGLGAEPPGGAPFAPCKRARFEDFCPDSSPDASNISNLISIFGSGFSGLVSRQPDSSEQPPPLNGQLCAKQALASLGAWTRAIVAF

SEQ ID NO: 13014 - protein, 463 aa, Homo sapiens
MATSKLPVVPGEEENTILMAKERLEALRTAFESGDLPQAASHLQELLASTESIRLEVGVTGESGAGKSSLINALRGLEAEDPGAALTGVMETTMQPSPYPHPQFPDVTLWDLPGAGSPGCPADKYLKQVDFSRYDFFLLVSPRRCGAVETRLAAEILCQGKKFYFVRTKVDEDLAATRTQRPSGFREAAVLQEIRDHCAERLREAGVADPRIFLVSNLSPARYDFPTLVSTWEHDLPSHRRHAGLLSLPDISLEALQKKKAMLQEQVLKTALVLGVIQALPVPGLAAAYDDALLIHSLRGYHRSFGLDDDSLAKLAEQVGKQAGDLRSVIRSPLANEVSPETVLRLYSQSSDGAMRVARAFERGIPVFGTLVAGGISFGAVYTMLQGCLNEMAEDAQRVRIKALEDDEPQPEVSLEVASDNGVEKGGSGEGGGEEAPLSTCRKLGLLLKYILDSWKKHDSEEK

SEQ ID NO: 13015 - protein, 623 aa, Homo sapiens
MPPPQGDVTALFLGPPGLGKSALIAALCDKDVETLEAPEGRPDSGVPSLRAAGPGLFLGELSCPPAAPGPWAAEANVLVLVLPGPEGNGEPLAPALGEAALAALARGTPLLAVRNLRPGDSQTAAQARDQTAALLNSAGLGAADLFVLPANCGSSDGCEELERLRAALQSQAEALRRLLPPAQDGFEVLGAAELEAVREAFETGGLEAALSWVRSGLERLGSARLDLAVAGKADVGLVVDMLLGLDPGDPGAAPASVPTAPTPFPAPERPNVVLWTVPLGHTGTATTAAAASHPTHYDALILVTPGAPTEKDWAQVQALLLPDAPLVCVRTDGEGEDPECLGEGKMENPKGESLKNAGGGGLENALSKGREKCSAGSQKAGSGEGPGKAGSEGLQQVVGMKKSGGGDSERAAALSPEDETWEVLEEAPPPVFPLRPGGLPGLCEWLRRALPPAQAGALLLALPPASPSAARTKAAALRAGAWRPALLASLAAAAAPLPGLGWACDVALLRGQLAEWRRGLGLEPTALARRERALGLASGELAARAHFPGPVTRAEVEARLGAWAGEGTAGGAALGALSFLWPAGGAAATGGLGYRAAHGVLLQALDEMRADAEAVLAPPEPAQ

SEQ ID NO: 13016 - protein, 1326 aa, Homo sapiens
MTTIHSRQMLQEHVSMEFSSSTTHVQTFSQTTKIVGEEVVRRKSSSIVEFFSLVTRSSNIPAGDSVPEFVEKPQPVTAPEGDKAVFRARVQGNAKPHISWKRESGIPIKESAKIFYDSINKEHVLKLEPLTSDDSDNYKCIASNDHADAIYTVSLLVTEGQEKMDFKKMLKKRAPPAPKKKQKKVANEKEMLEILSKVPKKDFEKVCMEYGFTDFRGLLRKLKEMKKKVEVEAIRILKPLEDKETKVDTTVVFDCIMELKDPNVKMIWIKGTEPLRIQYSLGKYDVKQMGTKYMLVISNVNMNDAGIYSLSVGDKRMSAELTVLDEPLKFLGEMKPVKVTERQTAVFEIRLSKKEPNFVWKFNGKELKRDDKYEITVSEDGLTHTLKIKDARLSDSGEFSAEAGNLVQKAQLTVDRIPIKFVSNLKNVRVKERSRACLECELTSKDVTLRWKKDGQLLMHGTKYSMNHEGKRAELIIEDAQLSDGGEYTVVAMQDGDPTEYYSTAIVTVEERLATVKSGMSDVHAATGSPAELCVVLNDEKVEGVWLKDGKEITDLPGMQIVKQGAVHKLIFPSMGPEHEGKYTFRAKGTESEASVFIADPPTIDPSVLEALAAHAITVKVGHTAHIKVPFRGKPLPKVTWYKDGMEVTEEERVSMERGEDQALLTISNCVREDSGLILLKLKNDHGSATATLHLSVLDRPKPPQGRVEFLELSGSCVHMKWKAPKDNGGRPVTQFIVERRAVGKKSWIKIGEVDGKVTNFSTNKVEEGKAYQFRILAVNSEGVSDPLETEEVFAGNPIEPPGFASQPQVTDVTKEAVTITWNAPTQDGGAPVLGYIVERRKKGSNLWVPVNKDPIQGTKCTVDGLLEDTEYEFRVIAVNKAGPGQPSVPSSSVVAKDPVKPPGLVQDLHVSDSSNSSISLAWREPAEGDPPSGYILEMRAEDTKEWSKCTKIPISGTCYTVGGLIERQKYFFRIRAVNEAGVGEPVELDKGVRAMPPPAAPKFDLSARLKSHMVVRAGTALCIHAAFSGSPPPDVIWQKDGVPTKGRETITKSKNHSQFLINSTKRSDSGVYRILLQNEFGEARYDIHVRVADFPRPPTNLRLFEEVPNTVTLTWNHSPDVQEDGEAHYIIMKRDASTATWYTAAERVFSNKYTVTGLLPGRKYYFRVVARNEIGDSEPLDSRDTWLINKDQIQDLSAKLKPYEKKDWRHAPRFVTPLKPHTVLRGQDCTMTCAFLGNPRPTVTLYKGDVNITANSKFWYNSTSGVCTLVIPTCTLKDSGDYSVLVENELGKDRSSCTLTVYDKDDKSVVASITESLQKKSKHLM

SEQ ID NO: 13017 - protein, 608 aa, Homo sapiens
MGWQPMGENWGCLEEMLNEDQSREPPGHLGSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEHARRPLGPSTCRRTCLGR

SEQ ID NO: 13018 - protein, 3708 aa, Homo sapiens
MAGKLRKSHIPGVSIWQLVEEIPEGCSTPDFEQKPVTSALPEGKNAVFRAVVCGEPRPEVRWQNSKGDLSDSSKYKISSSPGSKEHVLQINKLTGEDTDLYRCTAVNAYGEAACSVRLTVIEVGFRKNRKRHREPQEDLRKELMDFRKLLKKRAPPAPKKKMDLEQIWQLLMTADRKDYEKICLKYGIVDYRGMLRRLQEMKKEQEDKMAQYINTISSLRHIRVTKDGNAKFDLELDLKDSQSKIYLYKDGEMIPYGFNNQTKHCLRRLGKRYEFQIQDLRPEDSGIYQVKVEDAVVFSTELEASAIPPRVVVPLAETHCEEQGDAVFECTLSSPCPSAAWHFRHRLLHPSDKYEVYVSPDGLTHRLVVRGARFSDMGPYSLGTGLYTSSAWLVVEAGKDKDLQSTSADHKLQRQGAQASGAEESGSIESQGEKSREQGPRGGSLEGAGPASGLQHIASPDRDGLGRHGYSLMGDKGTADSAWGPGQEGEGFPVAEGSRATLPRENQSHREGGWARSLAERPHLQGESSESGLGLPEKQQQDRGRDSNSDECWRKAGGWEAGSSRLQAGGLGSSREGKEHRGDSGRQLDRHAPEQLWDARLGPGRGKSDLQGCQSDPVGSWPRGKQIEISQDDSLAEMDRGDAPSRERGRGIVVWGGGTGLGEAGDSNGAGGPGTLELTGGRGSGSKVGMAPESWGSQGGRDADYGEARGYWGSGELLEQIPGGKDFQEPSISGGRKFLLGDGSPEIKAEDSLQEADGICRGESVVTGSAYKTGPGGPGDPRGCEGVLQELRGRDGQETAWASGEVEYDPRSFQSSQGWTAGHRAAGGIGRIESKGTSPWDDTPSSLRKTGAHHGPGVLGPSGGQEGMGGIWVAGLTESGQGVDARSHWLSRAPGLGAQGSGGTLGDKKGLRGPGSIGSEPDFWNGSGSSRVKGPRGETGYKDGLEGPGRMESRYEGGLGYSREISSKSGAGYSYGSGVPGEMGSGHGAGCRVSPRAPAGVESEEGGGYRHGSGAPGGVWSGNEDSGPAGGGSGRVASLKNGSGGPDGAPMNDTRNWASACQAGMDPRGGHHSDGGLGSPGVTGSAGRGGLKAPGVVETVGMGCVEAEPESSGRIRPWGQTGNYGGFRASEALGAFGEGGYEDGSGGPGAMGPGSLRAGSKVGEGDGTRCPGAKASGAGAGYRDDTRHPESLAPHNGAASGSQWAYGAGNVLGYEDGSELPGPQGTGVRTAYGERSRGLGPRSTGPGGEAGFRDGSGGLQGMGSADGPGCRKGIGSSGEMGSVDKEGYKKDLGAPENMGSGSKADYRDGVGGSGAMGSMDEAGYRKDLGAPEGISSGSKADYRGGLQDSREAGSGSKADYSGGLKGSREIGSMDETDNRKDLGVPEGMGAGYRAGLRGPGEMGSLDESGHRNGIGGYGEMGSGYREDLGAPEGMGTGSKAGYRDGLRGSGEMRSMDEAGYRKNLGAPERMDSGSKAGYRGGLRGSGEMGLIEAGYRKDLGVSEGGGSGSKAGYRGGLGSGEMGSVDKAGYRKDLGASEAIGSGSKAGFTDGLGGSEEMGSVNKAGYRKDLGAPKGMGSGSKASFRDGLGGSGEMGSVNEAGYRKDLGVPEGIGSGSKAGFRDGLGGSEEMGSVNKAGYRKDLGAPKGIGSGSKAGFRDGLGSSGEMGSMDEAGYRKNLGAPEGIGSGSKAGFRDGLGSSVEMGSVNEAGYRKDLGAPEGMGSGSKAGFRDGLGGSGEMGSVNEAGYRKDLGAPKGIGSGSKADFRDALGSSGEMGSMDEAGYRKDLWAPEGIGSGSKAGFRDGLGSSVEMGSVNEAGYRKDLGAPEGMGSGSKAGFRDGLGGSGEMGSVNEAGYRKDLGAPKGIGSGSKADFRDALGSSGEMGSMDEAGYRKDLWAPEGIGSGSKAGFRDGLGSSVEMGSVNEAGYRKDLGAPEGMGSGSKEGFRDGLGGSEEMGSVNKAGYRKDLGAPKGMGSGSKEGFRDGLGGSEEMGSMDEAGYRKDLGAPEGIGSGSKAGFRDGLGGSEEMRSMDEAGYRKDLGAPERIGSGSKAGFRDGLGSSVEMGSVNEAGYRKDLGAPKGMGSGSKTGFRDGLGGSEEMESMDEAGYRKDLGAPEGIGSGSKAGFRDGLGSSTEMGSVNEAGYRKDLGAPKGMGSESKAGFRDGLGSSGEMGSMDEAGYRKDLGAPEGMGSGSKAGFRDGLGGSEEMGSVNKAGYRKDLGAPKGMGSGSKAGFRDGLGSSGEMGSMDEADYRKDLGAPEEMGSGSYTDYRNGLGSSGKISSGDEAGYKNVLGGSGRNPLGSEAGSRGSLEDSGYILSWNEAGSRQGFGGTSGMGSGSEVSYRGGSGGSGETGPEGKMGYGDGSGRLGVPGSLAGIGHEAGPRGHKAMGHRSGYWVASEGDTNSKDGPERARETRLVDGAGPGVEPGMAGMPGTAGGMAHRDSLRGTGVLGSQGGRQTLSDERGSTKDLGGYGTSGIPEASEAAGAKGKPDVKEWQDSSGTPGSSRDRGAPRVKDRSPDQAGIMGASGFLDGKGAVEGETWAGMAALGSGYERDIWKAGPGMTDRGRVAGQGGLASQGGGDSLLGGRRVGSGSSVGTGQDLDSGSMPGGRGKSTSGPADRQGTSNAWAPDWENQGFSQGSIDAGKQPAGSRASGSLQEKDAAFGGTHEGPGGFKGGEGAPGQEAAGGCRSPWSLDSKGSSPGRGSSVDAEDSGILGKGNSTEWGNALTPKPGESGPQGAWNGLDGPFGRKASRDRSGGTQDLSSQRGKGQRGGKRSLGEQGSLEAENGEVQGPGALKEDEGQGVEEAGRSGRRPGSLRSRSQAQSGAEVGGGKRRGADEAGSMGWQPMGENWGCLEEMLNEDQSREPPGHLGSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEAMPMPEVTWLKDGLPLPKRSVTVTKDGLTQLLIPVAGLSDSGLYTVVLRTLQGKEVAHSFRIRVAACPQAPGPIHLQENVPGTVTAEWEPSPDEAQDVPLHYAVFTRSSAHGPWHEAADRIHTNRFTLLGILPGHEYHFRVVAKNELGASKPSDTSQPWCIPRQRDRFTVKAPCYREPDLSQKPRFLVGLRSHLLPQGCECCMSCAVQGSPRPHVTWFKNDRSLEGNPAVYSTDLLGVCSLTIPSVSPKDSGEYKAVAENTLGQAVSTATLIVIEPST

SEQ ID NO: 13019 - protein, 570 aa, Homo sapiens
MAGKLRKSHIPGVSIWQLVEEIPEGCSTPDFEQKPVTSALPEGKNAVFRAVVCGEPRPEVRWQNSKGDLSDSSKYKISSSPGSKEHVLQINKLTGEDTDLYRCTAVNAYGEAACSVRLTVIEVGFRKNRKRHREPQEDLRKELMDFRKLLKKRAPPAPKKKMDLEQIWQLLMTADRKDYEKICLKYGIVDYRGMLRRLQEMKKEQEDKMAQYINTISSLRHIRVTKDGNAKFDLELDLKDSQSKIYLYKDGEMIPYGFNNQTKHCLRRLGKRYEFQIQDLRPEDSGIYQVKVEDAVVFSTELEASAIPPRVVVPLAETHCEEQGDAVFECTLSSPCPSAAWHFRHRLLHPSDKYEVYVSPDGLTHRLVVRGARFSDMGPYSLGTGLYTSSAWLVVEAGKDKDLQSTSADHKLQSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPIQTYH

SEQ ID NO: 13020 - protein, 481 aa, Homo sapiens
MMLKSITESFATAIHGLKVGHLTDRVIQRSKRMILDTLGAGFLGTTTEVFHIASQYSKIYSSNISSTVWGQPDIRLPPTYAAFVNGVAIHSMDFDDTWHPATHPSGAVLPVLTALAEALPRSPKFSGLDLLLAFNVGIEVQGRLLHFAKEANDMPKRFHPPSVVGTLGSAAAASKFLGLSSTKCREALAIAVSHAGAPMANAATQTKPLHIGNAAKHGIEAAFLAMLGLQGNKQVLDLEAGFGAFYANYSPKVLPSIASYSWLLDQQDVAFKRFPAHLSTHWVADAAASVRKHLVAERALLPTDYIKRIVLRIPNVQYVNRPFPVSEHEARHSFQYVACAMLLDGGITVPSFHECQINRPQVRELLSKVELEYPPDNLPSFNILYCEISVTLKDGATFTDRSDTFYGHWRKPLSQEDLEEKFRANASKMLSWDTVESLIKIVKNLEDLEDCSVLTTLLKGPSPPEVASNSPACNNSITNLS

SEQ ID NO: 13021 - protein, 481 aa, Homo sapiens
FPLKSITESFATAIHGLKVGHLTDRVIQRSKRMILDTLGAGFLGTTTEVFHIASQYSKIYSSNISSTVWGQPDIRLPPTYAAFVNGVAIHSMDFDDTWHPATHPSGAVLPVLTALAEALPRSPKFSGLDLLLAFNVGIEVQGRLLHFAKEANDMPKRFHPPSVVGTLGSAAAASKFLGLSSTKCREALAIAVSHAGAPMANAATQTKPLHIGNAAKHGIEAAFLAMLGLQGNKQVLDLEAGFGAFYANYSPKVLPSIASYSWLLDQQDVAFKRFPAHLSTHWVADAAASVRKHLVAERALLPTDYIKRIVLRIPNVQYVNRPFPVSEHEARHSFQYVACAMLLDGGITVPSFHECQINRPQVRELLSKVELEYPPDNLPSFNILYCEISVTLKDGATFTDRSDTFYGHWRKPLSQEDLEEKFRANASKMLSWDTVESLIKIVKNLEDLEDCSVLTTLLKGPSPPEVASNSPACNNSITNLS

SEQ ID NO: 13022 - protein, 320 aa, Homo sapiens
MAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSLKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEILNVKNVMVVVSRWYGGILLGPDRFKHINNCARNILVEKNYTNSPEESSKALGKNKKVRKDKKRNEH

SEQ ID NO: 13023 - protein, 163 aa, Homo sapiens [sequence omitted]

SEQ ID NO: 13024 - protein, 51 aa, Homo sapiens
MSGPLSPVCSCPQLPFMLSPCHMHHHPGHVALSQTVSPASLLTQGLGLPQH

SEQ ID NO: 13025 - protein, 924 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 13026 - protein, 924 aa, Homo sapiens; identical to SEQ ID NO: 13025

SEQ ID NO: 13027 - protein, 39 aa, Homo sapiens
MEIKEEGASEEGQHFLPTAQANDPGDCQFTSIQKTPNEP

SEQ ID NO: 13028 - protein, 131 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTIANSSRI

SEQ ID NO: 13029 - protein, 84 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIV

SEQ ID NO: 13030 - protein, 53 aa, Homo sapiens
MEIKEEGASEEGQHFLPTAQANDPGDCQFTSIQKTPNEPQLEFILDLNQELRD

SEQ ID NO: 13031 - protein, 924 aa, Homo sapiens; identical to SEQ ID NO: 13025

SEQ ID NO: 13032 - protein, 938 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRSRQTQGALNESDDPETGCLTDNKPTSRHFYPVALLLVSSHLLVVWLILSLALLLAKYQ

SEQ ID NO: 13033 - protein, 817 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKK

SEQ ID NO: 13034 - protein, 924 aa, Homo sapiens; identical to SEQ ID NO: 13025

SEQ ID NO: 13035 - protein, 656 aa, Homo sapiens
MGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKKECRNYVAGCNDLPQTEWYSFHLL

SEQ ID NO: 13036 - protein, 686 aa, Homo sapiens
MIHFHPLILPHERSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQS

SEQ ID NO: 13037 - protein, 1132 aa, Homo sapiens
MELFQAKDHYILQQGERALWCSRRDGGLQLRPATDLLLAWNPICLGLVEGVIGKIQLHSDLPWWLILIRQKALVGKLPGDHEVCKVTKIAVLSLSEMEPQDLELELCKKHHFGINKPEKIIPSPDDSKFLLKTFTHIKSNVSAPNKKKVKESKEKEKLERRLLEELLKMFMDSESFYYSLTYDLTNSVQRQSTGERDGRPLWQKVDDRFFWNKYMIQDLTEIGTPDVDFWIIPMIQGFVQIEELVVNYTESSDDEKSSPETPPQESTCVDDIHPRFLVALISRRSRHRAGMRYKRRGVDKNGNVANYVETEQLIHVHNHTLSFVQTRGSVPVFWSQVGYRYNPRPRLDRSEKETVAYFCAHFEEQLNIYKKQVIINLVDQAGREKIIGDAYLKQVLLFNNSHLTYVSFDFHEHCRGMKFENVQTLTDAIYDIILDMKWCWVDEAGVICKQEGIFRVNCMDCLDRTNVVQAAIARVVMEQQLKKLGVMPPEQPLPVKCNRIYQIMWANNGDSISRQYAGTAALKGDFTRTGERKLAGVMKDGVNSANRYYLNRFKDAYRQAVIDLMQGIPVTEDLYSIFTKEKEHEALHKENQRSHQELISQLLQSYMKLLLPDDEKFHGGWALIDCDPSLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 13038 - protein, 522 aa, Homo sapiens
MCHDVIFMAWLKQQFSECTLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 13039 - protein, 123 aa, Homo sapiens
MEPQDLELELCKKHHFGINKPEKIIPSPDDSKFLLKTFTHIKSNVSAPNKKKVKESKEKEKLERRLLEELLKMFMDSESFYYSLTYDLTNSVQRQSTGERDGRPLWQKVPLTARRAGFALGKK

SEQ ID NO: 13040 - protein, 375 aa, Homo sapiens
MELFQAKDHYILQQGERALWCSRRDGGLQLRPATDLLLAWNPICLGLVEGVIGKIQLHSDLPWWLILIRQKALVGKLPGDHEVCKVTKIAVLSLSEMEPQDLELELCKKHHFGINKPEKIIPSPDDSKFLLKTFTHIKSNVSAPNKKKVKESKEKEKLERRLLEELLKMFMDSESFYYSLTYDLTNSVQRQSTGERDGRPLWQKVDDRFFWNKYMIQDLTEIGTPDVDFWIIPMIQGFVQIEELVVNYTESSDDEKSSPETPPQESTCVDDIHPRFLVALISRRSRHRAGMRYKRRGVDKNGNVANYVETEQLIHVHNHTLSFVQTRGSVPVFWSQVGYRYNPRPRLDRSEKETVAYFCAHFEEQLNIYKKQQQK

SEQ ID NO: 13041 - protein, 168 aa, Homo sapiens
MSKRKWRGFRGAQQERAQPPAASPQPCPAPHAGLPGGSRRRAPAPAGQQQMRAESRSGAQRRRGSARRGAHREAGGCVRGRTRSSGSERSNALWQAVDAAEALALSSPLRRPWDQAQHFTNPAPFSKGPQSAPPSPPAGRRRRGADLALTPLAGEGHTRWRQPGRPGK

SEQ ID NO: 13042 - protein, 1042 aa, Homo sapiens
MELQKGKGAAAAAAASGAAGGGGGGAGAGAPGGGRLLLSTSLDAKDELEERLERCMSIVTSMTAGVSEREANDALNAYVCKGLPQHEEICLGLFTLILTEPAQAQKCYRDLALVSRDGMNIVLNKINQILMEKYLKLQDTCRTQLVWLVRELVKSGVLGADGVCMTFMKQIAGGDVTAKNIWLAESVLDILTEQREWVLKSSILIAMAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 13043 - protein, 447 aa, Homo sapiens
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 13044 - protein, 270 aa, Homo sapiens
MLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 13045 - protein, 335 aa, Homo sapiens
MPTFAGSQESRSQWILEHIPRDWDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 13046 - protein, 230 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLDGMKSREELFREVLEDIQNSLLNRSQESAPSPARPARTQGPGRGCGHRTARPAASQQDSM

SEQ ID NO: 13047 - protein, 186 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKYQKYRQEMEANGVEVVYLDGMKSREELFREVLEDIQNSLLNRSQESAPSPARPARTQGPGRGCGHRTARPAASQQDSM

SEQ ID NO: 13048 - protein, 474 aa, Homo sapiens
MSEESDGKLIEDSLIQLRCHFTWKLLIEAPEIPDLENRIWEEIQFLDTKYNVGIHNLLAYVKHLKGQNEEALVSLKKAEDLIQKEHANQADIRSLVTWGNFAWVYYHMGRLAEAQTYLDKVENTCKKFANPSRYRMECPEVDCEEGWALAKCGGKNYERAKTCFEKALEGNPENPEFNTGYAITVYRLDKFNTASGRNKAFSLHVLKRAVRLNPDDVYIRVLLALKLQDEGQEAEGEKYIEEALTSISSQAYVFQYAAKFYRRKGSVDKALELLKMALETTPTSAFLHHQMGLCYRAQMIQIKEATNWQPRGQDRETVDRLVQLAICKFEKTIMLKRTFEMAYVDLAETYAEIGHHRKAEEHFQKGLRMKIFEDQLKQEIHYHYGRFQEHHGKSQDKAITHYLKGLKIEKMSHSREKLLNALEKLAKRCIHQNVRVVESVSLLGLIHKLKGEVSDALLCYERALRLAADLNPIF

SEQ ID NO: 13049 - protein, 482 aa, Homo sapiens
MSEIRKDTLKAILLELECHFTWNLLKEDIDLFEVEDTIGQQLEFLTTKSRLALYNLLAYVKHLKGQNKDALECLEQAEEIIQQEHSDKEEVRSLVTWGNYAWVYYHMDQLEEAQKYTGKIGNVCKKLSSPSNYKLECPETDCEKGWALLKFGGKYYQKAKAAFEKALEVEPDNPEFNIGYAITVYRLDDSDREGSVKSFSLGPLRKAVTLNPDNSYIKVFLALKLQDVHAEAEGEKYIEEILDQISSQPYVLRYAAKFYRRKNSWNKALELLKKALEVTPTSSFLHHQMGLCYRAQMIQIKKATHNRPKGKDKLKVDELISSAIFHFKAAMERDSMFAFAYTDLANMYAEGGQYSNAEDIFRKALRLENITDDHKHQIHYHYGRFQEFHRKSENTAIHHYLEALKVKDRSPLRTKLTSALKKLSTKRLCHNALDVQSLSALGFVYKLEGEKRQAAEYYEKAQKIDPENAEFLTALCELRLSI

SEQ ID NO: 13050 - protein, 434 aa, Homo sapiens
MSEIRKDTLKAILLELECHFTWNLLKEDIDLFEVEDTIGQQLEFLTTKSRLALYNLLAYVKHLKGQNKDALECLEQAEEIIQQEHSDKEEVRSLVTWGNYAWVYYHMDQLEEAQKYTGKIGNVCKKLSSPSNYKLECPETDCEKGWALLKFGGKYYQKAVTLNPDNSYIKVFLALKLQDVHAEAEGEKYIEEILDQISSQPYVLRYAAKFYRRKNSWNKALELLKKALEVTPTSSFLHHQMGLCYRAQMIQIKKATHNRPKGKDKLKVDELISSAIFHFKAAMERDSMFAFAYTDLANMYAEGGQYSNAEDIFRKALRLENITDDHKHQIHYHYGRFQEFHRKSENTAIHHYLEALKVKDRSPLRTKLTSALKKLSTKRLCHNALDVQSLSALGFVYKLEGEKRQAAEYYEKAQKIDPENAEFLTALCELRLSI

SEQ ID NO: 13051 - protein, 686 aa, Homo sapiens
MKPPFLLALVVCSVVSTNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYKIELAGGLGAIFLLLVLLVVIYKCYNIELMLFYRQHFGADETNDDNKEYDAYLSYTKVDQDTLDCDNPEEEQFALEVLPDVLEKHYGYKLFIPERDLIPSGTYMEDLTRYVEQSRRLIIVLTPDYILRRGWSIFELESRLHNMLVSGEIKVILIECTELKGKVNCQEVESLKRSIKLLSLIKWKGSKSSKLNSKFWKHLVYEMPIKKKEMLPRCHVLDSAEQGLFGELQPIPSIAMTSTSATLVSSQADLPEFHPSDSMQIRHCCRGYKHEIPATTLPVPSLGNHHTYCNLPLTLLNGQLPLNNTLKDTQEFHRNSSLLPLSSKELSFTSDIW

SEQ ID NO: 13052 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 13053 - protein, 336 aa, Homo sapiens
MSRSVLEALTSSTAMQCVPSDGCAMLLRVRASITLHERLRGLEACAMSLDTQETQCQSVWVARASHRQQGGQQLQVHFGCFAVSVAQHLYVTLRTIPHFCGVQLDQRHLVEAGKLSYWVDRRRKAILVQVPRASGSPDYYLRLCLKRFTCEDAGAPVRVTANSVSQAVFLPYSQELPCLCLEGWSATPDAVRIQICPFENDTEALEVLWDTVYYHPESQTLSWEPACPVSGHVSLCWRPGPGAGCRKLQQSSQLVHRRVQYPLVDTQPQLCLKFSTSWGSWVRCPFEQRRFPTPPTSRCTCVTGGSHSSLPANAHSRPARSLQPQVTWQPPLLLPS

SEQ ID NO: 13054 - protein, 336 aa, Homo sapiens; identical to SEQ ID NO: 13053

SEQ ID NO: 13055 - protein, 156 aa, Homo sapiens [sequence omitted]

SEQ ID NO: 13056 - protein, 461 aa, Homo sapiens
MALAFGCPPGGGGGGCPGGGGGGGGAGPGPSPVTAALRDDLGSNIHLLKGLNVRFRCFLAKVHELERRNRLLEKQLEQQQSERERRLRYKTFSREQAVQTGPELLRPPAPGGGHGLSSGAAAGANANAVALGGLPPGGGSHPQHYGRLPGTIWSYTQVRRTGGGGVETVQGPGVSWVHPDGVGVQIDTITPEIRALYNVLAKVKRERDEYKRRWEEELAKRMNLQTMVDTLQEAAQEADAIQEEMNEKIERLKAELVVFKGLMSDVVPKKKERKVASDDDISEQDGEVNRFSDDEVGSMNITDEMKRMFNQLRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 13057 - protein, 517 aa, Homo sapiens
MVNSLLFGEMALAFGCPPGGGGGGCPGGGGGGGGAGPGPSPVTAALRDDLGSNIHLLKGLNVRFRCFLAKVHELERRNRLLEKQLEQQQSERERRLRYKTFSREQAVQTGPELLRPPAPGGGHGLSSGAAAGANANAVALGGLPPGGGSHPQHYGRLPGTIWSYTQVRRTGGGGVETVQGPGVSWVHPDGVGVQIDTITPEIRALYNVLAKVKRERDEYKRRWEEELAKRMNLQTMVDTLQEAAQEADAIQEEMNEKIERLKAELVVFKGLMSDPMTDLDTKIQEKAMKVDMDICRRIDITAKLCDVAQQRNSEDVSKIFQVVPKKKERKVASDDDISEQDGEVNRFSDDEVGSMNITDEMKRMFNQLRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 13058 - protein, 656 aa, Homo sapiens
MARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 13059 - protein, 1462 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKSEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 13060 - protein, 1462 aa, Homo sapiens; identical to SEQ ID NO: 13059

SEQ ID NO: 13061 - protein, 801 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKRA

SEQ ID NO: 13062 - protein, 132 aa, Homo sapiens
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 13063 - protein, 158 aa, Homo sapiens
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 13064 - protein, 114 aa, Homo sapiens
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERNELKISLL

SEQ ID NO: 13065 - protein, 132 aa, Homo sapiens; identical to SEQ ID NO: 13062

SEQ ID NO: 13066 - protein, 71 aa, Homo sapiens
DILGEAGLHFDELNKLRVLDPEVTQQTIELKEECKDFVDKIGQFQKIVGGLIELVDQLAKEAENEKMKVSG

SEQ ID NO: 13067 - protein, 185 aa, Homo sapiens
MVKLAAKCILADPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 13068 - protein, 129 aa, Homo sapiens
  MOD_RES (1)..(1): Any amino acid
XSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSV

SEQ ID NO: 13069 - protein, 183 aa, Homo sapiens
MVKLAAKCILAVPVDKRLSRAEVCSGCCEVCRSVSWTCALPAASEQVPVRGDPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALG

SEQ ID NO: 13070 - protein, 116 aa, Homo sapiens
MVKLAAKCILADPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLP

SEQ ID NO: 13071 - protein, 186 aa, Homo sapiens
MVKLAAKCILAGDPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 13072 - protein, 51 aa, Homo sapiens
MDLVVKTVPVPDTGDSVELFIFDSAGKELFSEMLDKLWESPNVLCLVYDVT

SEQ ID NO: 13073 - protein, 145 aa, Homo sapiens
MDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 13074 - protein, 437 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKNQGGKLAVLGSCHMFSDQYLDKEENSKIMDVVFQWLTTGDIHLNQIDAEDPEISDYMMLPYTATLSKRNRECLQESDEIPRDFTTLFDLSIFQLDTTSFHSVIEAHEQLNVKHEPLQLIQPQFETPLPTLQPAVFPPSFRELPPPPLELFDLDETFSSEKARLAQITNKCTEEDLEFYVRKCGDILGVTSKLPKDQQDAKHILEHVFFQVVEFKKLNQEHDIDTSETAFQNNF

SEQ ID NO: 13075 - protein, 437 aa, Homo sapiens; identical to SEQ ID NO: 13074

SEQ ID NO: 13076 - protein, 466 aa, Homo sapiens
MEPELLVRKVSALQACVRGFLVRRQFQSLRAEYEAIVREVEGDLGTLQWTEGRIPRPRFLPEKAKSHQTWKAGDRVANPEQGLWNHFPCEESEGEATWEEMVLKKSGESSANQGSLCRDHSSWLQMKQNRKPSQEKTRDTTRMENPEATDQRLPHSQPQLQELQYHRSHLAMELLWLQQAINSRKEYLLLKQTLRSPEAGPIREEPRVFLEHGEQACERDQSQPSAPLEDQSYRDRTTGELEQEDDSCHRVKSPHRSPGSLATTQKNIAGAKCREPCYSKSGPPSSIPSNSQALGDRLTKGPDDGRQTFGGTCLLQMKILEDQTPRGLKPRNHCPRKSRTQLSALYEDSNIKEMSPRKLDHKEPDCRTVRTQELGLSEDHIIWDGTLGGPEHSVLDLWRTKPPKGQAPTDRSSRDGTSNEPSHEGQKKQRTIPWRSKSPEILSSTKAGCTGEEQWRGRPWKTEPPG

SEQ ID NO: 13077 - protein, 546 aa, Homo sapiens
MEPELLVRKVSALQVRGRARGSQDFSFREIMGSRTWTSQRDATTFSPLTARQPLEIPAVPNRAEESWDPRTPCPARPHSHHTLAPDQGNGKSLKACVRGFLVRRQFQSLRAEYEAIVREVEGDLGTLQWTEGRIPRPRFLPEKAKSHQTWKAGDRVANPEQGLWNHFPCEESEGEATWEEMVLKKSGESSANQGSLCRDHSSWLQMKQNRKPSQEKTRDTTRMENPEATDQRLPHSQPQLQELQYHRSHLAMELLWLQQAINSRKEYLLLKQTLRSPEAGPIREEPRVFLEHGEQACERDQSQPSAPLEDQSYRDRTTGELEQEDDSCHRVKSPHRSPGSLATTQKNIAGAKCREPCYSKSGPPSSIPSNSQALGDRLTKGPDDGRQTFGGTCLLQMKILEDQTPRGLKPRNHCPRKSRTQLSALYEDSNIKEMSPRKLDHKEPDCRTVRTQELGLSEDHIIWDGTLGGPEHSVLDLWRTKPPKGQAPTDRSSRDGTSNEPSHEGQKKQRTIPWRSKSPEILSSTKAGCTGEEQWRGRPWKTEPPG

SEQ ID NO: 13078 - protein, 347 aa, Homo sapiens
MALDILAMAPLYQAPAINRIGPKTDPSKRPADPLKPLVLSRTKLTTIEAKRIMSILDEAIYKVELVTLLSYVASNREDMEGMLGEDVMRAVREHEDLCQVLLENVRCLKEKERQLQEQKEAEEEGWLRDRLLSIELQKSSLSPLMQQIKDSTKNVLRLLLSNPQAARLLQMQTQGRSAEAQNFIDSLIELRGFLFEKLLTSPMEARDKAQFLQDISRQNSNNQQIIDTLEKELAERMKNRNAEEELEDLDAVHREEKISLEELRRRHKVLVGEFAQIREEREINSKKRMEAEQEMVRMVRAATLIQALWKGYLVRSLLRSKKKRGKGKAKDKEKGKQKGKEKGKGKK

SEQ ID NO: 13079 - protein, 369 aa, Homo sapiens [sequence omitted]

SEQ ID NO: 13080 - protein, 449 aa, Homo sapiens
MALDILAMAPLYQAPAINRIGPKTDPSKRPADPLKPLVLSRTKLTTIEAKRIMSILDEAIYKVELVTLLSYVASNREDMEGMLGEDVMRAVREHEDLCQVLLENVRCLKEKERQLQEQKEAEEEGWLRDRLLSIELQKSSLSPLMQQIKDSTKNVLRLLLSNPQAARLLQMQTQGRSAEAQNFIDSLIELRGFLFEKLLTSPMEARDKAQFLQDISRQNSNNQQIIDTLEKELAERMKNRNAEVEKENFVIQELKNHLHQVLKFSENSLVRTKQEAEKQQKADFRASQARVAKIQQEILQLQSQFYNLVMENREAEQALRKKKYKVETEIENWIQKYDTEMGEKQEELEDLDAVHREEKISLEELRRRHKVLVGEFAQIREEREINSKKRMEAEQEMVRMVRAATLIQALWKGYLVRSLLRSKKKRGKGKAKDKEKGKQKGKEKGKGKK

SEQ ID NO: 13081 - protein, 205 aa, Homo sapiens
MEEKQPQKTKEPSKEDEPQQKEMPTHLSLGAESKAEAKTPVLVETQTVDNANEKSEKPPENQKKLSDKDTVATKIQAWWRGTLVRRALLHAALSACIIQCWWRLILSKILKKRRQAALEAFSRKEWAAVTLQSQARMWRIRRRYCQVLNAVRIIQAYWRCRSCASRGFIKGQYRVTANQLHLQLEILLDSGPCIVTECIPFSIKE

SEQ ID NO: 13082 - protein, 82 aa, Homo sapiens
MEEKQPQKTKEPSKEDEPQQKEMPTHLSLGAESKAEAKTPVLVETQTVDNANEKSEKRVCQWNMVIVSMDWKSLESEDLRNL

SEQ ID NO: 13083 - protein, 164 aa, Homo sapiens
MRVRFCTKGNLILVIIEDVEESIEWKTLQKKKQQKIKEKLRIRTKAAVKIQAWWRGTLVRRTLLHAALRAWIIQCWWRMTLSRVLEKKRQAALIAYATRERAVIKLQSLVRMWRVRWRYCQVLNAIYIIQGHWQCHNCQTCALLQGHCVVTATHLQFHIEIINS

SEQ ID NO: 13084 - protein, 154 aa, Homo sapiens
MGSKCCKGGPDEDAVERQRRQKLLLAQLHHRKRVKAAGQIQAWWRGVLVRRTLLVAALRAWMIQCWWRTLVQRRIRQRRQALLRVYVIQEQATVKLQSCIRMWQCRQCYRQMCNALCLFQVPESSLAFQTDGFLQVQYAIPSKQPEFHIEILSI

SEQ ID NO: 13085 - protein, 154 aa, Homo sapiens; identical to SEQ ID NO: 13084

SEQ ID NO: 13086 - protein, 154 aa, Homo sapiens; identical to SEQ ID NO: 13084

SEQ ID NO: 13087 - protein, 154 aa, Homo sapiens; identical to SEQ ID NO: 13084

SEQ ID NO: 13088 - protein, 121 aa, Homo sapiens
TKKKKKKKKRKEKKLRERSAAVFIQAWWRGMLVRRTLLHAALRAWIIQCWWRQVLEKLLAKRRRMVLEFYVQQEWAAVRLQSWVRMWCVRQRYCRLLNAVRIIQVYWRWHSCHSRVFIEGH

SEQ ID NO: 13089 - protein, 148 aa, Homo sapiens
MGPEEKTIMTERSAAVFIQAWWRGMLVRRTLLHAALRAWIIQCWWRQVLEKLLAKRRRMVLEFYVQQEWAAVRLQSWVRMWCVRQRYCRLLNAVRIIQVYWRWHSCHSRVFIEGHYELKENQLNIQLEISLGLQACKVQQCIPLPLKE

SEQ ID NO: 13090 - protein, 107 aa, Homo sapiens
MVRRTLLQAALRAWVIQCWWRSMQAKMLEQRRRLALRLYTCQEWAVVKVQAQVRMWQARRRFLQARQAACIIQSHWRWHASQTRGLIRGHYEVRASRLELDIEILMT

SEQ ID NO: 13091 - protein, 189 aa, Homo sapiens
MAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFEPTAANPTLAPADRRGSSPLHSILLESLCGSL

SEQ ID NO: 13092 - protein, 287 aa, Homo sapiens
MAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKVKCKMEDDAVPAAKMKIPSS

SEQ ID NO: 13093 - protein, 199 aa, Homo sapiens
MLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKVKCKMEDDAVPAAKMKIPSS

SEQ ID NO: 13094 - protein, 239 aa, Homo sapiens
MAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQQFAVILRFKNCVSGRRNFARPSTFTSKSKFSGPSKNKK

SEQ ID NO: 13095 - protein, 819 aa, Homo sapiens
MYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 13096 - protein, 822 aa, Homo sapiens
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 13097 - protein, 670 aa, Homo sapiens
MYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMFTPSAGEVAALQKNLKRSTSR

SEQ ID NO: 13098 - protein, 781 aa, Homo sapiens
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQEEDEKWKMSPSLFLPAMKEGCNAYKEIWMKKDESWNFSQDYDPELIKEEKRKELQSEIRIQVDELMRQELKNLKLAVDRERERPVKAGKKKDKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 13099 - protein, 830 aa, Homo sapiens
MTPSLSAEENRMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 13100 - protein, 482 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKVQMQVRNSKASFDKLKMDVCQKVDLLGASRCNMLSHSLTTYQRTLLGFWKKTARMMSQIHEACIGFHPYDFVALKQLQDTPSKISEDNKDEQIGGFLTEQLNKLVLSDEEASFESEQANKDHNEKHSQMREFGAPQFSNSENVAKDLPVDSLEGEDFEKEFSFLNNLLSSGSSSTSEFTQECQTAFGSPSASLTSQEPSMGSEPLAHSSRFLPSQLFDLGFHVAGAFNNWVSQEESELCLSHTDNQPVPSQSPKKLTRSPNNGNQDMSAWFNLFADLDPLSNPDAIGHSDDELLNA

SEQ ID NO: 13101 - protein, 482 aa, Homo sapiens; identical to SEQ ID NO: 13100

SEQ ID NO: 13102 - protein, 78 aa, Homo sapiens
MDSFGQPRPEDNQSVVRRMQKKYWKTKQVFIKATGKKEDEHLVASDAELDAKLEVFHSVQETCTELLKIIEKYQLRLN

SEQ ID NO: 13103 - protein, 119 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQ

SEQ ID NO: 13104 - protein, 98 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERD

SEQ ID NO: 13105 - protein, 124 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALC

SEQ ID NO: 13106 - protein, 42 aa, Homo sapiens
MDSFGQPRPEDNQSVVRRMQKKYWKTKQVFIKATGKKEDEHL

SEQ ID NO: 13107 - protein, 99 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDA

SEQ ID NO: 13108 - protein, 134 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEV

SEQ ID NO: 13109 - protein, 119 aa, Homo sapiens; identical to SEQ ID NO: 13103

SEQ ID NO: 13110 - protein, 151 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINR

SEQ ID NO: 13111 - protein, 97 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAER

SEQ ID NO: 13112 - protein, 100 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDAT

SEQ ID NO: 13113 - protein, 135 aa, Homo sapiens
MVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 13114 - protein, 248 aa, Homo sapiens
MALCEAAGCGSALLWPRLLLFGDSITQFSFQQGGWGASLADRLVRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 13115 - protein, 135 aa, Homo sapiens; identical to SEQ ID NO: 13113

SEQ ID NO: 13116 - protein, 451 aa, Homo sapiens
MEAGPPGSARPAEPGPCLSGQRGADHTASASLQSVAGTEPGRHPQAVAAVLPAGGCGERMGVPTPKQFCPILERPLISYTLQALERVCWIKDIVVAVTGENMEVMKSIIQKYQHKRISLVEAGVTRHRSIFNGLKALAEDQINSKLSKPEVVIIHDAVRPFVEEGVLLKVVTAAKEHGAAGAIRPLVSTVVSPSADGCLDYSLERARHRASEMPQAFLFDVIYEAYQQCSDYDLEFGTECLQLALKYCCTKAKLVEGSPDLWKVTYKRDLYAAESIIKERISQEICVVMDTEEDNKHVGHLLEEVLKSELNHVKVTSEALGHAGRHLQQIILDQCYNFVCVNVTTSDFQETQKLLSMLEESSLCILYPVVVVSVHFLDFKLVPPSQKMENLMQIREFAKEVKERNILLYGLLISYPQDDQKLQESLRQGAIIIASLIKERNSGLIGQLLIA

SEQ ID NO: 13117 - protein, 331 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGCRSGTRPARSGSAPSPRATTAVPMGPSLPTTSPRGAPSCRCLTGLRM

SEQ ID NO: 13118 - protein, 556 aa, Homo sapiens
MASKPAAGKSRGEKRKRVVLTLKEKIDICTRLEKGESRKALMQEYNVGMSTLYDIRAHKAQLLRFFASSDSNKALEQRRTLHTPKLEHLDRVLYEWFLGKRSEGVPVSGPMLIEKAKDFYEQMQLTEPCVFSGGWLWRFKARHGIKKLDASSEKQSADHQAAEQFCAFFRSLAAEHGLSAEQVYNADETGLFWRCLPNPTPEGGAVPGPKQGKDRLTVLMCANATGSHRLKPLAIGKCSGPRAFKGIQHLPVAYKAQGNAWVDKEIFSDWFHHIFVPSVREHFRTIGLPEDSKAVLLLDSSRAHPQEAELVSSNVFTIFLPASVASLVQPMEQGIRRDFMRNFINPPVPLQGPHARYNMNDAIFSVACAWNAVPSHVFRRAWRKLWPSVAFAEGSSSEEELEAECFPVKPHNKSFAHILELVKEGSSCPGQLRQRQAASWGVAGREAEGGRPPAATSPAEVVWSSEKTPKADQDGRGDPGEGEEVAWEQAAVAFDAVLRFAERQPCFSAQEVGQLRALRAVFRSQQQETVGLEDVVVTSPEELAIPKCCLEASTET

SEQ ID NO: 13119 - protein, 568 aa, Homo sapiens
MASKPAAGKSRGEKRKRVVLTLKEKIDICTRLEKGESRKALMQEYNVGMSTLYDIRAHKAQLLRFFASSDSNKALEQRRTLHTPKLEHLDRVLYEWFLGKRSEGVPVSGPMLIEKAKDFYEQMQLTEPCVFSGGWLWRFKARHGIKKLDASSEKQSADHQAAEQFCAFFRSLAAEHGLSAEQVYNADETGLFWRCLPNPTPEGGAVPGPKQGKDRLTVLMCANATGSHRLKPLAIGKCSGPRAFKGIQHLPVAYKAQGNAWVDKEIFSDWFHHIFVPSVREHFRTIGLPEDSKAVLLLDSSRAHPQEAELVSSNVFTIFLPASVASLVQPMEQGIRRDFMRNFINPPVPLQGPHARYNMNDAIFSVACAWNAVPSHVFRRAWRKLWPSVAFAEGSSSEEELEAECFPVKPHNKSFAHILELVKEGSSCPGQLRQRQAASWGVAGREAEGGRPPAATSPAEVVWSSEKTPKADQDGRGDPGEGEEVAWEQAAVAFDAVLRFAERQPCFSAQEVGQLRALRAVFRSQQQVRRRRGALGAVVKVEALQEGPGGCGATAQSPLPCSSTAGDN

SEQ ID NO: 13120 - protein, 319 aa, Homo sapiens
MKGEIQQSLGAWVLLTCLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 13121 - protein, 311 aa, Homo sapiens
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 13122 - protein, 305 aa, Homo sapiens
MACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 13123 - protein, 202 aa, Homo sapiens
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 13124 - protein, 104 aa, Homo sapiens
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKR

SEQ ID NO: 13125 - protein, 62 aa, Homo sapiens
MSCVPWKGDKAKSESLELPQAAPPQIYHEKQRRELCALHALNNVFQDSNAFTRDTLQEIFQR

SEQ ID NO: 13126 - protein, 61 aa, Homo sapiens
MSCVPWKGDKAKSESLELPQAAPPQIYHEKQRRELCALHALNNVFQDSNAFTRDTLQEIFQ

SEQ ID NO: 13127 - protein, 208 aa, Homo sapiens
GDAETPGSVERRGRRGAEDGMSQAPGAQPSPPTVYHERQRLELCAVHALNNVLQQQLFSQEAADEICKRLAPDSRLNPHRSLLGTGNYDVNVIMAALQGLGLAAVWWDRRRPLSQLALPQVLGLILNLPSPVSLGLLSLPLRRRHWVALRQVDGVYYNLDSKLRAPEALGDEDGVRAFLAAALAQGLCEVLLVVTKEVEEKGSWLRTD

SEQ ID NO: 13128 - protein, 188 aa, Homo sapiens
MSQAPGAQPSPPTVYHERQRLELCAVHALNNVLQQQLFSQEAADEICKRLAPDSRLNPHRSLLGTGNYDVNVIMAALQGLGLAAVWWDRRRPLSQLALPQVLGLILNLPSPVSLGLLSLPLRRRHWVALRQVDGVYYNLDSKLRAPEALGDEDGVRAFLAAALAQGLCEVLLVVTKEVEEKGSWLRTD

SEQ ID NO: 13129 - protein, 146 aa, Homo sapiens
MSQAPGAQPSPPTVYHERQRLELCAVHALNNVLQQQLFSQEAADEICKRPLSQLALPQVLGLILNLPSPVSLGLLSLPLRRRHWVALRQVDGVYYNLDSKLRAPEALGDEDGVRAFLAAALAQGLCEVLLVVTKEVEEKGSWLRTD

SEQ ID NO: 13130 - protein, 188 aa, Homo sapiens; identical to SEQ ID NO: 13128

SEQ ID NO: 13131 - protein, 463 aa, Homo sapiens
MRAGPEPQALAGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 13132 - protein, 440 aa, Homo sapiens
  MOD_RES (1)..(1): Any amino acid
XALAGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 13133 - protein, 316 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKVPWIPLDPLAPDLARYPSYSQAQALRCTVRAGEMLYLPALWFHHVQQSQGCIAVNFWYDMEYDLKYSYFQLLDSLTKASGLD

SEQ ID NO: 13134 - protein, 334 aa, Homo sapiens [sequence omitted]

SEQ ID NO: 13135 - protein, 285 aa, Homo sapiens
MAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 13136 - protein, 304 aa, Homo sapiens
MVTGGAHSRSRGGLPSASRRGLFRGGPKEVTSGVRPGSRPLPRRRSCRPMAGGWAQGSRRAARLPEGGRLMAPASRLLALWALAAVALPGSGAEGDGGWYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 13137 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 13138 - protein, 745 aa, Homo sapiens; identical to SEQ ID NO: 13137

SEQ ID NO: 13139 - protein, 629 aa, Homo sapiens [sequence omitted]

SEQ ID NO: 13140 - protein, 529 aa, Homo sapiens [sequence omitted]

SEQ ID NO: 13141 - protein, 152 aa, Homo sapiens
MREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTQKDATAIGDLLTLYCGLMETALD

SEQ ID NO: 13142 - protein, 492 aa, Homo sapiens
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 13143 - protein, 69 aa, Homo sapiens
MNRIRIHVLPTNRGRITPVPRSQEPLSCAFTHRPCSHPRLEGQEFCIKHILEDKNAPFKQCSYISTKNG

SEQ ID NO: 13144 - protein, 791 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 13145 - protein, 878 aa, Homo sapiens
MAHRGGERDFQTSARRMGTSLLFQLSVHERELDLVFLDHSYAKPWSAHPDASSARPTRMLFVTPRRQHESTIESDVPIDVETVTSTPMPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 13146 - protein, 141 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKVILTFCG

SEQ ID NO: 13147 - protein, 530 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSTPLPVYSWFHH

SEQ ID NO: 13148 - protein, 764 aa, Homo sapiens
MTLPHCHRLMLTHHLFWTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 13149 - protein, 352 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNL

SEQ ID NO: 13150 - protein, 442 aa, Homo sapiens
MSAAQGWDRNRRRGGGAAGAGGGGSGAGGGSGGSGGRGTGQLNRFVQLSGRPHLPGKKKIRWDPVRRRFIQSCPIIRIPNRFLRGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 13151 - protein, 520 aa, Homo sapiens
MGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 13152 - protein, 258 aa, Homo sapiens
MVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKKLRSGWRRRTRKRTVRRLRAPRVGSTTKTAERRAVRRTESPCQGRLASAVPTSAQDPAVLSEALGASVRPDAQERAEGGWPRPGCELSPMV

SEQ ID NO: 13153 - protein, 489 aa, Homo sapiens
MGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 13154 - protein, 463 aa, Homo sapiens
MGKKGKKEKKGRGAEKTAAKMEKKVSKRSRKEETFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 13155 - protein, 505 aa, Homo sapiens
MSAEEMVQIRLEDRCYPVSKRKLIEQSDYFRALYRSGMREALSQEAGGPEVQQLRGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRDRNMNILQYCPSSDMWTLFETCDVHIRKQQMVSVEETIYIVGGCLHELGPNRRSSQSEDMLTVQSYNTVTRQWLYLKENTSKSGLNLTCALHNDGIYIMSRDVTLSTSLEHRVFLKYNIFSDSWEAFRRFPAFGHNLLVSSLYLPNKAET

SEQ ID NO: 13156 - protein, 594 aa, Homo sapiens
MVLRSHPFPRQDRPQGSVPRAVPGSPVGPSTSTHSEDRHGPSSSVGTVIGTGTGGLVEAGGQPQPRSSETNGSPSPDPPPGLRGEGTREKSLDPLPQAAMPRGPAQPPAQRPPGPAASSSARRSQPVPQLRKRSRCEIAPSSEQEVRPAASGDPQGEAPGEGGSPAGRSGALTEKQEEARKLMVFLQRPGGWGVVEGPRKPSSRALEPATAAALRRRLDLGSCLDVLAFAQQHGEPGLAQETYALMSDNLLRVLGDPCLYRRLSAADRERILSLRTGRGRAVLGVLVLPSLYQGGRSGLPRGPRGEEPPAAAPVSLPLPAHLHVFNPRENTWRPLTQVPEEAPLRGCGLCTMHNYLFLAGGIRGSGAKAVCSNEVFCYNPLTNIWSQVRPMQQARAQLKLVALDGLLYAIGGECLYSMECYDPRTDAWTPRAPLPAGTFPVAHEAVACRGDIYVTGGHLFYRLLRYSPVKDAWDECPYSASHRRSSDIVALGGFLYRFDLLRGVGAAVMRYNTVTGSWSRAASLPLPAPAPLHCTTLGNTIYCLNPQVTATFTVSGGTAQFQAKELQPFPLGSTGVLSPFILTLPPEDRLQTSL

SEQ ID NO: 13157 - protein, 350 aa, Homo sapiens
MEVPNVKDFQWKRLAPLPSRRVYCSLLETGGQVYAIGGCDDNGVPMDCFEVYSPEADQWTALPRLPTARAGVAVTALGKRIMVIGGVGTNQLPLKVVEMYNIDEGKWKKRSMLREAAMGISVTAKDYRVYAAGGMGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEILPAMPTPRCACSSIVVKNCLLAVGGVNQGLSDAVEALCVSDS

SEQ ID NO: 13158 - protein, 350 aa, Homo sapiens; identical to SEQ ID NO: 13157

SEQ ID NO: 13159 - protein, 237 aa, Homo sapiens
MIAGCRSFSLQSDYRVYAAGGMGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEILPAMPTPRCACSSIVVKNCLLAVGGVNQGLSDAVEALCVSDS

SEQ ID NO: 13160 - protein, 350 aa, Homo sapiens; identical to SEQ ID NO: 13157

SEQ ID NO: 13161 - protein, 349 aa, Homo sapiens
MAVAVPPGRAAGSGWAWRPVARDALLARAFHSCTELRGRFYLVGGLLAGGAREPSSDTVVFDPARGQAVRLGARGSPPRSHHDAAPVDGRWLCVVGGWDGSRRLATVTALDTERGVWEAWTGTPGDCPPAGLSSHTCTRISDRELQVAGREGGIHTQRRYGSIYTLRLDPSARTYCYKQEGCHTASRSGHCAALLQTPGPHPGHQLLLFGGCNLAEPEVAGHWSHGKIKEEPPVAPHLMEQLARLVSSGQGSQKGPHGLRHHSCSVVGPFAVLFGGETLTRARDTICNDLYIYDTRTSPPLWFHFPCADRGMKRMGHRTCLWNDQLYLVGGFGEDGRTASPQVCILDFI

SEQ ID NO: 13162 - protein, 288 aa, Homo sapiens
MAVAVPPGRAAGSGWAWRPVARDALLARAFHSCTELRGRFYLVGGLLAGGAREPSSDTVVFDPARGQAVRLGARGSPPRSHHDAAPVDGRWLCVVGGWDGSRRLATVTALDTERGVWEAWTGTPGDCPPAGLSSHTCTRISDRELQVAGREGGIHTQRRYGSIYTLRLDPSARTYCYKQEGCHTASRSGHCAALLQTPGPHPGHQLLLFGGCNLAEPEVAGHWSHGKIKSFLSPQGGTTCCSSFDGTACKACEQWAGVPEGAPWTTASLMFCGRALCCAVWWRNSDQS

SEQ ID NO: 13163 - protein, 623 aa, Homo sapiens
MEHAVAPCVLYPGTEPGAAGESESEGAASPAQTPCSLGASLCFSSGEESPPQSLASAAEGAATSPPSSGGPRVVERQWEAGSAGAASPEELASPEERACPEEPAAPSPEPRVWLEDPASPEEPGEPAPVPPGFGAVYGEPDLVLEVSGRRLRAHKAVLAARSDYFRARASRDVLRVQGVSLTALRLLLADAYSGRMAGVRPDNVAEVVAGARRLQLPGAAQRATDAVGPQLSLANCYEVLSAAKRQRLNELRDAAYCFMSDHYLEVLREPAVFGRLSGAERDLLLRRRLRAGRAHLLAAALGPAGERAGSRPQSPSGDADARGDAAVYCFHAAAGEWRELTRLPEGAPARGCGLCVLYNYLFVAGGVAPAGPDGRARPSDQVFCYNPATDSWSAVRPLRQARSQLRLLALDGHLYAVGGECLLSVERYDPRADRWAPVAPLPRGAFAVAHEATTCHGEIYVSGGSLFYRLLKYDPRRDEWQECPCSSSRERSADMVALDGFIYRFDLSGSRGEAQAAGPSGVSVSRYHCLAKQWSPCVAPLRLPGGPTGLQPFRCAALDGAIYCVSRAGTWRFQPAREGEAGGDAGQGGGFEALGAPLDVRGVLIPFALSLPEKPPRGEQGAP

SEQ ID NO: 13164 - protein, 623 aa, Homo sapiens
MECKIEGKEKYQHSLNLLNKIQNMKELAEMIDVVLTAEGEKFPCHRLVLAAFSPYFKAMFTCGLLECNQREVILYDITAESVSVLLNYMYNAALEINNANVQTVAMAAYFMQMEEVFSVCQKYMMDHMDASNCLGIYYFAKQIGAEDLSDRSKKYLYQHFAEVSLHEEILEIEVHQFLTLIKSDDLNISREESILDLVLRWVNHNKELRTVHLVELLKQVRLELVNPSFLRQALRRNTMLLCDADCVDIIQNAFKAIKTPQQHSLNLRYGMETTSLLLCIGNNSSGIRSRHRSYGDASFCYDPVSRKTYFISSPKYGEGLGTVCTGVVMENNTIIVAGEASASKLSRQKNKNVEIYRYHDRGNQFWEKLCTAEFRELYALGSIHNDLYVIGGQMKIKNQYLITNCVDKYSVERDNWKRVSPLPLQLACHAVVTVNNKLYVIGGWTPQMDLPDEEPDRLSNKLLQYDPSQDQWSVRAPMKYSKYRFSTAVVNSEIYVLGGIGCVGQDKGQVRKCLDVVEIYNPDGDFWREGPPMPSPLLSLRTNSTNAGAVDGKLYVCGGFHGADRHEVISKEILELDPWENQWNVVAINVLMHDSYDVCLVARMNPRDLIPPPSDLVEEGNEH

SEQ ID NO: 13165 - protein, 623 aa, Homo sapiens; identical to SEQ ID NO: 13164

SEQ ID NO: 13166 - protein, 623 aa, Homo sapiens
MSTQDERQINTEYAVSLLEQLKLFYEQQLFTDIVLIVEGTEFPCHKMVLATCSSYFRAMFMSGLSESKQTHVHLRNVDAATLQIIITYAYTGNLAMNDSTVEQLYETACFLQVEDVLQRCREYLIKKINAENCVRLLSFADLFSCEELKQSAKRMVEHKFTAVYHQDAFMQLSHDLLIDILSSDNLNVEKEETVREAAMLWLEYNTESRSQYLSSVLSQIRIDALSEVTQRAWFQGLPPNDKSVVVQGLYKSMPKFFKPRLGMTKEEMMIFIEASSENPCSLYSSVCYSPQAEKVYKLCSPPADLHKVGTVVTPDNDIYIAGGQVPLKNTKTNHSKTSKLQTAFRTVNCFYWFDAQQNTWFPKTPMLFVRIKPSLVCCEGYIYAIGGDSVGGELNRRTVERYDTEKDEWTMVSPLPCAWQWSAAVVVHDCIYVMTLNLMYCYFPRSDSWVEMAMRQTSRSFASAAAFGDKIFYIGGLHIATNSGIRLPSGTVDGSSVTVEIYDVNKNEWKMAANIPAKRYSDPCVRAVVISNSLCVFMRETHLNERAKYVTYQYDLELDRWSLRQHISERVLWDLGRDFRCTVGKLYPSCLEESPWKPPTYLFSTDGTEEFELDGEMVALPPV

SEQ ID NO: 13167 - protein, 14 aa, Homo sapiens
MSTQDERQINTEYA

SEQ ID NO: 13168 - protein, 4 aa, Homo sapiens
MSTQ

SEQ ID NO: 13169 - protein, 48 aa, Homo sapiens
MSTQDERQINTEYAVSLLEQLKLFYEQQLFTDIVLIVEGTEFPCHKMV

SEQ ID NO: 13170 - protein, 29 aa, Homo sapiens
MSTQDERQINTEYAVSLLEQLKLFYEQQL

SEQ ID NO: 13171 - protein, 349 aa, Homo sapiens
VREAAMLWLEYNTESRSQYLSSVLSQIRIDALSEVTQRAWFQGLPPNDKSVVVQGLYKSMPKFFKPRLGMTKEEMMIFIEASSENPCSLYSSVCYSPQAEKVYKLCSPPADLHKVGTVVTPDNDIYIAGGQVPLKNTKTNHSKTSKLQTLQNCELLLLDAQQNTSKDPNAFCPHKAIFCCEGYIYAIGGDSVGGELNRRTVERYDTEKDEWTMVSPLPCAWQWSAAVVVHDCIYVMTLNLMYCYFPRSDSWVEMAMRQTSRSFASAAAFGDKIFYIGGLHIATNSGIRLPSGTVDGSSVTVEIYDVNKNEWKMAANIPAKRYSDPCVRAVVISNSLCVFMRETHLNERA

SEQ ID NO: 13172 - protein, 612 aa, Homo sapiens
MELAMDNSYAFNQRSTCNGIPSEKKNNFLVSEDHGQKILSVLQNFREQNVFYDFKIIMKDEIIPCHRCVLAACSDFFRAMFEVNMKERDDGSVTITNLSSKAVKAFLDYAYTGKTKITDDNVEMFFQLSSFLQVSFLSKACSDFLIKSINLVNCLQLLSISDSYGSTSLFDHALHFVQHHFSLLFKSSDFLEMNFGVLQKCLESDELNVPEEEMVLKVVLSWTKHNLESRQKYLPHLIEKVRLHQLSEETLQDCLFNEESLLKSTNCFDIIMDAIKCVQGSGGLFPDARPSTTEKYIFIHKTEENGENQYTFCYNIKSDSWKILPQSHLIDLPGSSLSSYGEKIFLTGGCKGKCCRTVRLHIAESYHDATDQTWCYCPVKNDFFLVSTMKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCPDTCVWKGEGSFECAGFNAGAIGIEDKIYILGGDYAPDEITDEVQVYHSNRSEWEEVSPMPRALTEFYCQVIQFNKYRDPWFSNLCA

SEQ ID NO: 13173 - protein, 612 aa, Homo sapiens; identical to SEQ ID NO: 13172

SEQ ID NO: 13174 - protein, 318 aa, Homo sapiens
MKGGNADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFNALGFWPAQCKWETAFRADRHSDSSIRLPSCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWE

SEQ ID NO: 13175 - protein, 518 aa, Homo sapiens
MESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 13176 - protein, 534 aa, Homo sapiens
MKGGNADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 13177 - protein, 621 aa, Homo sapiens
MALGLEQAEEQRLYQQTLLQDGLKDMLDHGKFLDCVVRAGEREFPCHRLVLAACSPYFRARFLAEPERAGELHLEEVSPDVVAQVLHYLYTSEIALDEASVQDLFAAAHRFQIPSIFTICVSFLQKRLCLSNCLAVFRLGLLLDCARLAVAARDFICAHFTLVARDADFLGLSADELIAIISSDGLNVEKEEAVFEAVMRWAGSGDAEAQAERQRALPTVFESVRCRLLPRAFLESRVERHPLVRAQPELLRKVQMVKDAHEGRITTLRKKKKGKDGAGAKEADKGTSKAKAEEDEEAERILPGILNDTLRFGMFLQDLIFMISEEGAVAYDPAANECYCASLSNQVPKNHVSLVTKENQVFVAGGLFYNEDNKEDPMSAYFLQFDHLDSEWLGMPPLPSPRCLFGLGEALNSIYVVGGREIKDGERCLDSVMCYDRLSFKWGESDPLPYVVYGHTVLSHMDLVYVIGGKGSDRKCLNKMCVYDPKKFEWKELAPMQTARSLFGATVHDGRIIVAAGVTDTGLTSSAEVYSITDNKWAPFEAFPQERSSLSLVSLVGTLYAIGGFATLETESGELVPTELNDIWRYNEEEKKWEGVLREIAYAAGATFLPVRLNVLCLTKM

SEQ ID NO: 13178 - protein, 366 aa, Homo sapiens
MVKDAHEGRITTLRKKKKGKDGAGAKEADKGTSKAKAEEDEEAERILPGILNDTLRFGMFLQDLIFMISEEGAVAYDPAANECYCASLSNQVPKNHVSLVTKENQVFVAGGLFYNEDNKEDPMSAYFLQFDHLDSEWLGMPPLPSPRCLFGLGEALNSIYVVGGREIKDGERCLDSVMCYDRLSFKWGESDPLPYVVYGHTVLSHMDLVYVIGGKGSDRKCLNKMCVYDPKKFEWKELAPMQTARSLFGATVHDGRIIVAAGVTDTGLTSSAEVYSITDNKWAPFEAFPQERSSLSLVSLVGTLYAIGGFATLETESGELVPTELNDIWRYNEEEKKWEGVLREIAYAAGATFLPVRLNVLCLTKM

SEQ ID NO: 13179 - protein, 674 aa, Homo sapiens
MQSREDAPRSRRLASPRGGKRPKKIHKPTVSAFFTGPEELKDTAHSAALLAQLKSFYDARLLCDVTIEVVTPGSGPGTGRLFPCNRNVLAAACPYFKSMFTGGMYESQQASVTMHDVDAESFEVLVDYCYTGRVSLSEANVERLYAASDMLQLEYVREACASFLARRLDLTNCTAILKFADAFGHRKLRSQAQSYIAQNFKQLSHMGSIREETLADLTLAQLLAVLRLDSLDVESEQTVCHVAVQWLEAAPKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCCDPYSGDLYKVPSPLTCLAHTRTVTTLAVCISPDHDIYLAAQPRTDLWVYKPAQNSWQQLADRLLCREGMDVAYLNGYIYILGGRDPITGVKLKEVECYNVKRNQWALVAPLPHSFLSFDLMVIRDYLYALNSKRMFCYDPSHNMWLKCVSLKRNDFQEACVFNEEIYCICDIPVMKVYNPVRAEWRQMNNIPLVSETNNYRIIKHGQKLLLITSRTPQWKKNRVTVYEYDIRGDQWINIGTTLGLLQFDSNFFCLSARVYPSCLEPGQSFLTEEEEIPSESSTEWDLGGFSEPDSESGSSSSLSDDDFWVRVAPQ

SEQ ID NO: 13180 - protein, 608 aa, Homo sapiens
MQSREDAPRSRRLASPRGGKRPKKIHKPTVSAFFTGPEELKDTASVTMHDVDAESFEVLVDYCYTGRVSLSEANVERLYAASDMLQLEYVREACASFLARRLDLTNCTAILKFADAFGHRKLRSQAQSYIAQNFKQLSHMGSIREETLADLTLAQLLAVLRLDSLDVESEQTVCHVAVQWLEAAPKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCCDPYSGDLYKVPSPLTCLAHTRTVTTLAVCISPDHDIYLAAQPRTDLWVYKPAQNSWQQLADRLLCREGMDVAYLNGYIYILGGRDPITGVKLKEVECYNVKRNQWALVAPLPHSFLSFDLMVIRDYLYALNSKRMFCYDPSHNMWLKCVSLKRNDFQEACVFNEEIYCICDIPVMKVYNPVRAEWRQMNNIPLVSETNNYRIIKHGQKLLLITSRTPQWKKNRVTVYEYDIRGDQWINIGTTLGLLQFDSNFFCLSARVYPSCLEPGQSFLTEEEEIPSESSTEWDLGGFSEPDSESGSSSSLSDDDFWVRVAPQ

SEQ ID NO: 13181 - protein, 684 aa, Homo sapiens
MQSREDVPRSRRLASPRGGRRPKRISKPSVSAFFTGPEELKDTAHSAALLAQLKSFYDARLLCDVTIEVVTPGSGPGTGRLFSCNRNVLAAACPYFKSMFTGGMYESQQASVTMHDVDAESFEVLVDYCYTGRVSLSEANVQRLYAASDMLQLEYVREACASFLARRLDLTNCTAILKFADAFDHHKLRSQAQSYIAHNFKQLSRMGSIREETLADLTLAQLLAVLRLDSLDIESERTVCHVAVQWLEAAAKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCYDPYSGDIYTMPSPLTSFAHTKTVTSSAVCVSPDHDIYLAAQPRKDLWVYKPAQNSWQQLADRLLCREGMDVAYLNGYIYILGGRDPITGVKLKEVECYSVQRNQWALVAPVPHSFYSFELIVVQNYLYAVNSKRMLCYDPSHNMWLNCASLKRSDFQEACVFNDEIYCICDIPVMKVYNPARGEWRRISNIPLDSETHNYQIVNHDQKLLLITSTTPQWKKNRVTVYEYDTREDQWINIGTMLGLLQFDSGFICLCARVYPSCLEPGQSFITEEDDARSESSTEWDLDGFSELDSESGSSSSFSDDEVWVQVAPQRNAQDQQGSL

SEQ ID NO: 13182 - protein, 586 aa, Homo sapiens
MFTGGMYESQQASVTMHDVDAESFEVLVDYCYTGRVSLSEANVQRLYAASDMLQLEYVREACASFLARRLDLTNCTAILKFADAFDHHKLRSQAQSYIAHNFKQLSRMGSIREETLADLTLAQLLAVLRLDSLDIESERTVCHVAVQWLEAAAKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCYDPYSGDIYTMPSPLTSFAHTKTVTSSAVCVSPDHDIYLAAQPRKDLWVYKPAQNSWQQLADRLLCREGMDVAYLNGYIYILGGRDPITGVKLKEVECYSVQRNQWALVAPVPHSFYSFELIVVQNYLYAVNSKRMLCYDPSHNMWLNCASLKRSDFQEACVFNDEIYCICDIPVMKVYNPARGEWRRISNIPLDSETHNYQIVNHDQKLLLITSTTPQWKKNRVTVYEYDTREDQWINIGTMLGLLQFDSGFICLCARVYPSCLEPGQSFITEEDDARSESSTEWDLDGFSELDSESGSSSSFSDDEVWVQVAPQRNAQDQQGSL

SEQ ID NO: 13183 - protein, 575 aa, Homo sapiens
MDPFHACSILKQLKTMYDEGQLTDIVVEVDHGKTFSCHRNVLAAISPYFRSMFTSGLTESTQKEVRIVGVEAESMDLVLNYAYTSRVILTEANVQALFTAASIFQIPSIQDQCAKYMISHLDPQNSIGVFIFADHYGHQELGDRSKEYIRKKFLCVTKEQEFLQLTKDQLISILDSDDLNVDREEHVYESIIRWFEHEQNEREVHLPEIFAKCIRFPLMEDTFIEKIPPQFAQAIAKSCVEKGPSNTNGCTQRLGMTASEMIICFDAAHKHSGKKQTVPCLDIVTGRVFKLCKPPNDLREVGILVSPDNDIYIAGGYRPSSSEVSIDHKAENDFWMYDHSTNRWLSKPSLLRARIGCKLVYCCGKMYAIGGRVYEGDGRNSLKSVECYDSRENCWTTVCAMPVAMEFHNAVEYKEKIYVLQGEFFLFYEPQKDYWGFLTPMTVPRIQGLAAVYKDSIYYIAGTCGNHQRMFTVEAYDIELNKWTRKKDFPCDQSINPYLKLVLFQNKLHLFVRATQVTVEEHVFRTSRKNSLYQYDDIADQWMKVYETPDRLWDLGRHFECAVAKLYPQCLQKVL

SEQ ID NO: 13184 - protein, 601 aa, Homo sapiens
MAASADLSKSSPTPNGIPSSDPASDAMDPFHACSILKQLKTMYDEGQLTDIVVEVDHGKTFSCHRNVLAAISPYFRSMFTSGLTESTQKEVRIVGVEAESMDLVLNYAYTSRVILTEANVQALFTAASIFQIPSIQDQCAKYMISHLDPQNSIGVFIFADHYGHQELGDRSKEYIRKKFLCVTKEQEFLQLTKDQLISILDSDDLNVDREEHVYESIIRWFEHEQNEREVHLPEIFAKCIRFPLMEDTFIEKIPPQFAQAIAKSCVEKGPSNTNGCTQRLGMTASEMIICFDAAHKHSGKKQTVPCLDIVTGRVFKLCKPPNDLREVGILVSPDNDIYIAGGYRPSSSEVSIDHKAENDFWMYDHSTNRWLSKPSLLRARIGCKLVYCCGKMYAIGGRVYEGDGRNSLKSVECYDSRENCWTTVCAMPVAMEFHNAVEYKEKIYVLQGEFFLFYEPQKDYWGFLTPMTVPRIQGLAAVYKDSIYYIAGTCGNHQRMFTVEAYDIELNKWTRKKDFPCDQSINPYLKLVLFQNKLHLFVRATQVTVEEHVFRTSRKNSLYQYDDIADQWMKVYETPDRLWDLGRHFECAVAKLYPQCLQKVL

SEQ ID NO: 13185 - protein, 315 aa, Homo sapiens
MDVNKFEASVGFLDVKKFLSTWKLQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARL

SEQ ID NO: 13186 - protein, 204 aa, Homo sapiens
MQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSDMMVIPC

SEQ ID NO: 13187 - protein, 568 aa, Homo sapiens
MGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSGAGVALLNDHIYVVGGFDGTAHLSSVEAYNIRTDSWTTVTSMTTPRCYVGATVLRGRLYAIAGYDGNSLLSSIECYDPIIDSWEVVTSMGTQRCDAGVCVLREK

SEQ ID NO: 13188 - protein, 606 aa, Homo sapiens
MDVNKFEASVGFLDVKKFLSTWKLQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSGAGVALLNDHIYVVGGFDGTAHLSSVEAYNIRTDSWTTVTSMTTPRCYVGATVLRGRLYAIAGYDGNSLLSSIECYDPIIDSWEVVTSMGTQRCDAGVCVLREK

SEQ ID NO: 13189 - protein, 604 aa, Homo sapiens
MAGDVEGFCSSIHDTSVSAGFRALYEEGLLLDVTLVIEDHQFQAHKALLATQSDYFRIMFTADMRERDQDKIHLKGLTATGFSHVLQFMYYGTIELSMNTVHEILQAAMYVQLIEVVKFCCSFLLAKICLENCAEIMRLLDDFGVNIEGVREKLDTFLLDNFVPLMSRPDFLSYLSFEKLMSYLDNDHLSRFPEIELYEAVQSWLRHDRRRWRHTDTIIQNIRFCLMTPTSVFEKVKTSEFYRYSRQLRYEVDQALNYFQNVHQQPLLDMKSSRIRSAKPQTTVFRGMIGHSMVNSKILLLKKPRVWWELEGPQVPLRPDCLAIVNNFVFLLGGEELGPDGEFHASSKVFRYDPRQNSWLQMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPETDQWTILASMPIGRSGHGVTVLDKQIMVLGGLCYNGHYSDSILTFDPDENKWKEDEYPRMPCKLDGLQVCNLHFPDYVLDEVRRCN

SEQ ID NO: 13190 - protein, 574 aa, Homo sapiens
MVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLRERLHPKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLVASCGRLYAVGGYDGQSNLSSVEMYDPETDCWTFMAPMACHEGGVGVGCIPLLTI

SEQ ID NO: 13191 - protein, 462 aa, Homo sapiens
MGASFLQLQSIKDACCTFLRERLHPKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLVASCGRLYAVGGYDGQSNLSSVEMYDPETDCWTFMAPMACHEGGVGVGCIPLLTI

SEQ ID NO: 13192 - protein, 634 aa, Homo sapiens
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 13193 - protein, 491 aa, Homo sapiens
MSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 13194 - protein, 235 aa, Homo sapiens
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLH

SEQ ID NO: 13195 - protein, 558 aa, Homo sapiens
MALKGQEDYIYLFKDSTHPVDFLDAFRTFYLDGLFTDITLQCPSGIIFHCHRAVLAACSNYFKAMFTADMKEKFKNKIKLSGIHHDILEGLVNYAYTSQIEITKRNVQSLLEAADLLQFLSVKKACERFLVRHLDIDNCIGMHSFAEFHVCPELEKESRRILCSKFKEVWQQEEFLEISLEKFLFILSRKNLSVWKEEAIIEPVIKWTAHDVENRIECLYNLLSYINIDIDPVYLKTALGLQRSCLLTENKIRSLIYNALNPMHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKGVGNATACVLHDVIYVIGGHCGYRGSCTYDKVQSYNSDINEWSLITSSPHPEYGLCSVPFENKLYLVGGQTTITECYDPEQNEWREIAPMMERRMECGAVIMNGCIYVTGGYSYSKGTYLQSIEKYDPDLNKWEIVGNLPSAMRSHGCVCVYNV

SEQ ID NO: 13196 - protein, 558 aa, Homo sapiens; identical to SEQ ID NO: 13195

SEQ ID NO: 13197 - protein, 615 aa, Homo sapiens
MAESGGSSGGAGGGGAFGAGPGPERPNSTADKNGALKCTFSAPSHSTSLLQGLATLRAQGQLLDVVLTINREAFPAHKVVLAACSDYFRAMFTGGMREASQDVIELKGVSARGLRHIIDFAYSAEVTLDLDCVQDVLGAAVFLQMLPVVELCEEFLKAAMSVETCLNIGQMATTFSLASLRESVDAFTFRHFLQIAEEEDFLRLPLERLVFFLQSNRLQSCAEIDLFRAAVRWLQHDPARRPRASHVLCHIRFPLMQSSELVDSVQTLDIMVEDVLCRQYLLEAFNYQVLPFRQHEMQSPRTAVRSDVPSLVTFGGTPYTDSDRSVSSKVYQLPEPGARHFRELTEMEVGCSHTCVAVLDNFVYVAGGQHLQYRSGEGAVDACYRYDPHLNRWLRLQAMQESRIQFQLNVLCGMVYATGGRNRAGSLASVERYCPRRNEWGYACSLKRRTWGHAGAASGGRLYISGGYGISVEDKKALHCYDPVADQWEFKAPMSEPRVLHAMVGAGGRIYALGGRMDHVDRCFDVLAVEYYVPETDQWTSVSPMRAGQSEAGCCLLERKIYIVGGYNWRLNNVTGIVQVYNTDTDEWERDLHFPESFAGIACAPVLLPRAGTRR

SEQ ID NO: 13198 - protein, 145 aa, Homo sapiens [sequence omitted]

SEQ ID NO: 13199 - protein, 571 aa, Homo sapiens
MDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVKFLTRLYEANHLIRDDRTCKHLLNEALKYHFMPEHRLSHQTVLMTRPRCAPKVLCAVGGKSGLFACLDSVEMYFPQNDSWIGLAPLNIPRYEFGICVLDQKVYVIGGIATNVRPGVTIRKHENSVECWNPDTNTWTSLERMNESRSTLGVVVLAGELYALGGYDGQSYLQSVEKYIPKIRKWQPVAPMTTTRSCFAAAVLDGMIYAIGGYGPAHMNSVERYDPSKDSWEMVASMADKRIHFGVGVMLGFIFVVGGHNGVSHLSSIERYDPHQNQWTVCRPMKEPRTGVGAAVIDNYLYVVGGHSGSSYLNTVQKYDPISDTWLDSAGMIYCRCNFGLTAL

SEQ ID NO: 13200 - protein, 84 aa, Homo sapiens
MDHTSPTYMLANLTHLHSEQLLQGLNLLRQHHELCDIILRVGDVKIHAHKVVLASVSPYFKAMFTGNLSEKENSEVEFQCIDET

SEQ ID NO: 13201 - protein, 162 aa, Homo sapiens
MDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQ

SEQ ID NO: 13202 - protein, 45 aa, Homo sapiens
MDHTSPTYMLANLTHLHSEQLLQGLNLLRQHHELCDIILRVGDVK

SEQ ID NO: 13203 - protein, 875 aa, Homo sapiens
MSRHHSRFERDYRVGWDRREWSVNGTHGTTSICSVTSGAGGGTASSLSVRPGLLPLPVVPSRLPTPATAPAPCTTGSSEAITSLVASSASAVTTKAPGISKGDSQSQGLATSIRWGQTPINQSTPWDTDEPPSKQMRESDNPGTGPWVTTVAAGNQPTLIAHSYGVAQPPTFSPAVNVQAPVIGVTPSLPPHVGPQLPLMPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVERYDTITNQWEAVAPLPKAVHSAAATVCGGKIYVFGGVNEAGRAAGVLQSYVPQTNTWSFIESPMIDNKYAPAVTLNGFVFILGGAYARATTIYDPEKGNIKAGPNMNHSRQFCSAVVLDGKIYATGGIVSSEGPALGNMEAYEPTTNTWTLLPHMPCPVFRHGCVVIKKYIQSG

SEQ ID NO: 13204 - protein, 560 aa, Homo sapiens
MLDGLQRLRSQPKLADVTLLVGGRELPCHRGLLALSSPYFHAMFAGDFAESFSARVELRDVEPAVVGQLVDFVYTGRLTITQGNVEALTRTAARLHFPSVQKVCGRYLQQQLDAANCLGICEFGEQQGLLGVAAKAWAFLRENFEAVAREDEFLQLPRERLVTCLAGDLLQVQPEQSRLEALMRWVRHDPQARAAHLPELLSLVHLDAVPRPCVQQLLASEPLIQESEACRAALSQGHDGAPLALQQKLEEVLVVVGGQALEEEEAGEEPTPGLGNFAFYNSKAKRWMALPDFPDYHKWGFSLAALNNNIYVTGGSRGTKTDTWSTTQAWCFPLKEASWKPVAPMLKPRTNHASAALNGEIYVIGGTTLDVVEVESYDPYTDSWTPVSPALKYVSNFSAAGCRGRLYLVGSSACKYNALALQCYNPVTDAWSVIASPFLPKYLSSPRCAALHGELYLIGDNTKKVYVYDPGANLWQKVQSQHSLHENGALVPLGDALYVTGGRWQGMEGDYHVEMEAYDTVRDTWTRHGALPRLWLYHGASTVFLDVSKWTQPSGPTQEH

SEQ ID NO: 13205 - protein, 578 aa, Homo sapiens
MVRNVDDLDFHLPSHAQDMLDGLQRLRSQPKLADVTLLVGGRELPCHRGLLALSSPYFHAMFAGDFAESFSARVELRDVEPAVVGQLVDFVYTGRLTITQGNVEALTRTAARLHFPSVQKVCGRYLQQQLDAANCLGICEFGEQQGLLGVAAKAWAFLRENFEAVAREDEFLQLPRERLVTCLAGDLLQVQPEQSRLEALMRWVRHDPQARAAHLPELLSLVHLDAVPRPCVQQLLASEPLIQESEACRAALSQGHDGAPLALQQKLEEVLVVVGGQALEEEEAGEEPTPGLGNFAFYNSKAKRWMALPDFPDYHKWGFSLAALNNNIYVTGGSRGTKTDTWSTTQAWCFPLKEASWKPVAPMLKPRTNHASAALNGEIYVIGGTTLDVVEVESYDPYTDSWTPVSPALKYVSNFSAAGCRGRLYLVGSSACKYNALALQCYNPVTDAWSVIASPFLPKYLSSPRCAALHGELYLIGDNTKKVYVYDPGANLWQKVQSQHSLHENGALVPLGDALYVTGGRWQGMEGDYHVEMEAYDTVRDTWTRHGALPRLWLYHGASTVFLDVSKWTQPSGPTQEH

SEQ ID NO: 13206 - protein, 139 aa, Homo sapiens
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQVE

SEQ ID NO: 13207 - protein, 206 aa, Homo sapiens
MVESGADEVNLHGVTSLGLKQALEFAYTGQILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQKCGICAAFCALRGDWCPGLPQWDDKTASCEVVGTQLPLPVHGRAPAIHPLWPNGCGYSPYSCPVPPPCPSK

SEQ ID NO: 13208 - protein, 620 aa, Homo sapiens
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 13209 - protein, 176 aa, Homo sapiens
ILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQKCGICAAFCALRGDWCPGLPQWDDKTASCEVVGTQLPLPVHGRAPAIHPLWPNGCGYSPYSCPVPPPCPSK

SEQ ID NO: 13210 - protein, 584 aa, Homo sapiens
MPSERCLSIQEMLTGQRLCHSESHNDSVLAALNQQRSDGILCDITLIAEEQKFHAHKAVLAACSDYFRILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 13211 - protein, 551 aa, Homo sapiens
MPSERCLSIQEMLTGQRLCHSESHNDSVLAALNQQRSDGILCDITLIAEEQKFHAHKAVLAACSDYFRELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 13212 - protein, 176 aa, Homo sapiens
MLPLSHPGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 13213 - protein, 533 aa, Homo sapiens
MLLSGMRESQGTEVSLRTISTQDLRLLVSFAYSGVVRARWPGLLRAAQAALQYQSSSCLDLCQKGLARGLSPARCLALFPMAEAPGLERLWSKARHYLLTHLPAVALCPAFPSLPAACLAELLDSDELHVQEEFEAFVAARCWLAANPETQESEAKALLRCVRFGRMSTRELRRVRAAGLLPPLTPDLLHQLMVEADVPGQERRREPDRALVVIGGDGLRPDMALRQPSRAVWWARAFRCGVGLVRTVEWGQLPALPAPGRFRHGAASLAGSELYVCGGQDFYSHSNTLASTLRWEPSQEDWEEMAPLSQARSLFSLVALDGKLYALGGRHNDVALDSVETYNPELNVWRPAPALPAPCFAHAAAILEGQLYVSGGCGGTGQYLASLMHYDPKLEKPGTFLSPMGVPRAGHVMAALGGRLYVAGGLGETEDLLSFEAYELRTDSWTHLAPLPSPHVGAASAVLQGELLVLGGYSHRTYALSHLIHAYCPGLGRWLCLGTLPRPRAEMPACILTLPAVQHIALVPTPHQTKPAG

SEQ ID NO: 13214 - protein, 644 aa, Homo sapiens
MSYFLSYCKAHGGALLTGYQALRAEGFLCDVTLETEGSEFPAHRSLLACSSDYFRALFKSHTQESRARVIHLHVPSAAGLQRLLDFIYTAWLSLSMDTVEDTLEAASYLQVTEALGLCGRYLERQLAPENCCFAANVAARFGLAHTLDAAERCIVSHLQELLARGAGPAGLLELNPTSLRAVLGAPDVARVPEARLLGLALAWLRQEPTTERLAHCTELLERVRFGLVPADVLRRVYSGSGLVLPARVKGLIIQALNYHTTPSRQPLMQGEQTSIRSPQTRILLVGGRRAREVVIEEVAAPQRAARGQVAAPEPEEEEEELEEEEEEEEWELTQNVVAFDVYNHRWRSLTQLPTPLLGHSVCTAGNFLFVLGGESPSGSASSPLADDSRVVTAQVHRYDPRFHAWTEVPAMREARAHFWCGAVGERLLAVGGLGAGGEVLASVEMYDLRRDRWTAAGALPRALHGHAGAVGDRGVVYISGGKAGRGEGGASSLRDLYVLGPEEQVWSKKAPMGTARFGHHMAVLRGAVFAFLGRYEPFSEIERYDPGADQWTRLRPLPYDRFCYGLAVVEETALLLGGLKWRDSRQVPTRNVVGYDLDLDRWEDIGCALPWAWSGLRCAVLQLAEGGDDEREGEVGEALDLVLG

SEQ ID NO: 13215 - protein, 363 aa, Homo sapiens
MRWVRHDAPARRGQLRRLLEHVRLPLLAPAYFLEKVEADELLQACGECRPLLLEARACFILGREAGALRTRPRRFMDLAEVIVVIGGCDRKGLLKLPFADAYHPESQRWTPLPSLPGYTRSEFAACALRNDVYVSGGHINSHDVWMFSSHLHTWIKVASLHKGRWRHKMAVVQGQLFAVGGFDGLRRLHSVERYDPFSNTWAAAAPLPEAVSSAAVASCAGKLFVIGGARQGGVNTDKVQCFDPKEDRWSLRSPAPFSQRCLEAVSLEDTIYVMGGLMSKIFTYDPGTDVWGEAAVLPSPVESCGVTVCDGKVHILGGRDDRGESTDKVFTFDPSSGQVEVQPSLQRCTSSHGCVTIIQSLGR

SEQ ID NO: 13216 - protein, 583 aa, Homo sapiens
MRQGHAPEESEPGCEAPCAGPCHAQRVLQALNAYRRSGTLTDVVLRAGGRDFPCHRAALSAGSAYFRSLFAAGRPERGPAVVPVVPVAPEAPGTSPAGAAAALAVVLDYVYGAGVRLRAEDEAAAVLALAERLGVAGLREACVRFLEGRLRAANSLALRRVAAAFSLAPLAERCGRVLRQAFAEVARHADFLELAPDEVVALLADPALGVAREEAVFEAAMRWVRHDAPARRGQLRRLLEHVRLPLLAPAYFLEKVEADELLQACGECRPLLLEARACFILGREAGALRTRPRRFMDLAEVIVVIGGCDRKGLLKLPFADAYHPESQRWTPLPSLPGYTRSEFAACALRNDVYVSGGHINSHDVWMFSSHLHTWIKVASLHKGRWRHKMAVVQGQLFAVGGFDGLRRLHSVERYDPFSNTWAAAAPLPEAVSSAAVASCAGKLFVIGGARQGGVNTDKVQCFDPKEDRWSLRSPAPFSQRCLEAVSLEDTIYVMGGLMSKIFTYDPGTDVWGEAAVLPSPVESCGVTVCDGKVHILGGRDDRGESTDKVFTFDPSSGQVEVQPSLQRCTSSHGCVTIIQSLGR

SEQ ID NO: 13217 - protein, 553 aa, Homo sapiens
MMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRFTYGHAGTIYKDFVYISGGHDYQIGPYRKNLLCYDHRTDVWEERRPMTTARGWHSMCSLGDSIYSIGGSDDNIESMERFDVLGVEAYSPQCNQWTRVAPLLHANSESGVAVWEGRIYILGGYSWENTAFSKTVQVYDREADKWSRGVDLPKAIAGGSACVCALEPRPEDKKKKGKGKRHQDRGQ

SEQ ID NO: 13218 - protein, 616 aa, Homo sapiens
MMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRYDPRCKQWIKVASMNQRRVDFYLASIEDMLVAIGGRNENGALSSVETYSPKTDSWSYVAGLPRFTYGHAGTIYKDFVYISGGHDYQIGPYRKNLLCYDHRTDVWEERRPMTTARGWHSMCSLGDSIYSIGGSDDNIESMERFDVLGVEAYSPQCNQWTRVAPLLHANSESGVAVWEGRIYILGGYSWENTAFSKTVQVYDREADKWSRGVDLPKAIAGGSACVCALEPRPEDKKKKGKGKRHQDRGQ

SEQ ID NO: 13219 - protein, 616 aa, Homo sapiens; identical to SEQ ID NO: 13218

SEQ ID NO: 13220 - protein, 581 aa, Homo sapiens
MDEESLDGLLFKDHDFSSDLLRQLNSLRQSRILTDVSICAGAREIPCHRNVLASSSPYFRAMFCSSFREKSEAKVQLKGIDPPTLDQIVSYVYTGEAHIATDNVLPVMEAASMLQFPKLFEACSSYLQSQLAPSNCLGMIRLSEILSCETLKKKAREVALTSFPEVAASADLKELCALELRDYLGDDGLCGEEEKVFEALMVWIKHDLQARKRYMQELFKQVRLQYIHPAFFHHFIANDALLQSSPACQIILETAKRQMFSLCGTTVPDCKLLLHVPPRNSYQDFLILLGGRKDSQQTTRDVLLYSKQTGQWQSLAKLPTRLYKASAITLHRSIYVLGGMAVSSGRSLVSHNVYIFSLKLNQWRLGEPMLVARYSHRSTAHKNFIFSIGGIGEGQELMGSMERYDSICNVWESMASMPVGVLHPAVAVKDQRLYLFGGEDIMQNPVRLIQVYHISRNSWFKMETRMIKNVCAPAVVLGERIVIVGGYTRRILAYDPQSNKFVKCADMKDRRMHHGATVMGNKLYVTGGRRLTTDCNIEDSASFDCYDPETDTWTSQGQLPHKLFDHACLTLQCIPRTSGLP

SEQ ID NO: 13221 - protein, 617 aa, Homo sapiens
MKVSLGNGEMGVSAHLQPCKAGTTRFFTSNTHSSVVLQGFDQLRIEGLLCDVTLVPGDGDEIFPVHRAMMASASDYFKAMFTGGMKEQDLMCIKLHGVNKVGLKKIIDFIYTAKLSLNMDNLQDTLEAASFLQILPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQTVDFMRTDNTCVNLLLEASNYQMMPYMQPVMQSDRTAIRSDSTHLVTLGGVLRQQLVVSKELRMYDERAQEWRSLAPMDAPRYQHGIAVIGNFLYVVGGQSNYDTKGKTAVDTVFRFDPRYNKWMQVASLNEKRTFFHLSALKGHLYAVGGRSAAGELATVECYNPRMNEWSYVAKMSEPHYGHAGTVYGGLMYISGGITHDTFQNELMCFDPDTDKWMQKAPMTTVRGLHCMCTVGDKLYVIGGNHFRGTSDYDDVLSCEYYSPTLDQWTPIAAMLRGQSDVGVAVFENKIYVVGGYSWNNRCMVEIVQKYDPEKDEWHKVFDLPESLGGIRACTLTVFPPEENPGSPSRESPLSAPSDHS

SEQ ID NO: 13222 - protein, 549 aa, Homo sapiens
MMASASDYFKAMFTGGMKEQDLMCIKLHGVNKVGLKKIIDFIYTAKLSLNMDNLQDTLEAASFLQILPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQTVDFMRTDNTCVNLLLEASNYQMMPYMQPVMQSDRTAIRSDSTHLVTLGGVLRQQLVVSKELRMYDERAQEWRSLAPMDAPRYQHGIAVIGNFLYVVGGQSNYDTKGKTAVDTVFRFDPRYNKWMQVASLNEKRTFFHLSALKGHLYAVGGRSAAGELATVECYNPRMNEWSYVAKMSEPHYGHAGTVYGGLMYISGGITHDTFQNELMCFDPDTDKWMQKAPMTTVRGLHCMCTVGDKLYVIGGNHFRGTSDYDDVLSCEYYSPTLDQWTPIAAMLRGQSDVGVAVFENKIYVVGGYSWNNRCMVEIVQKYDPEKDEWHKVFDLPESLGGIRACTLTVFPPEENPGSPSRESPLSAPSDHS

SEQ ID NO: 13223 - protein, 177 aa, Homo sapiens
MTTSIRQFTSSSSIKGSSGLGGGSSRTSCQLSGGLGAGSCRPGSAGGLGSALGGSSYSSCYSFGSGGGYGSSSFEGVDGLLVGGEKATMQNLNDRLASYLDKVRALEEADTELEVKIRDWYQRQAPGPARDYSQYYRIIEELQNKPPWTMPTSCYILTMPIWLLLTSAPKSWQNEGR

SEQ ID NO: 13224 - protein, 441 aa, Homo sapiens
MTTSIRQFTSSSSIKGSSGLGGGSSRTSCQLSGGLGAGSCRPGSAGGLGSALGGSSYSSCYSFGSGGGYGSSSFEGVDGLLVGGEKATMQNLNDRLASYLDKVRALEEADTELEVKIRDWYQRQAPGPARDYSQYYRIIEELQNKILTATVDNANILLHIDNAHLAAADFRTKFETEQALCLSVEADINGPCRVLDELTLARADLEMHIENLKEELAYLKKNHEEMNAPRGQVGGEINVEMGAAPGVDLSRILNEMREQYEKMAEKNRKDAEDWFFSKTEELNREVATNSELVQSGKSEISELRCTMQALEIELQSQLSMKASLEGNLAETENRYCMQLSQIQGLIGSVEERLAQLLCEMEQQNQEYKILLDMKMRLELEITTYHRLLEGEDAHEGLLAPTHFKLPASPAAVTTCQVPTIVEEVQDGKVISSREQVRQTTR

SEQ ID NO: 13225 - protein, 121 aa, Homo sapiens
MASCSTSGTCGSSCCQPSCCETSCCQPSCCQTSSCGTGCGIGGGIGYGQEGSGGSVSTRIRWCHPDCHVEGTCLPPCYLVSCTPPSCCQLHHAEASCCRPSYCGQSCCRPACCCHCCEPTC

SEQ ID NO: 13226 - protein, 123 aa, Homo sapiens
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCGQPTPCSTTCRTSSC

SEQ ID NO: 13227 - protein, 129 aa, Homo sapiens
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCGQPSPCGQPTPCSTTCRTSSC

SEQ ID NO: 13228 - protein, 155 aa, Homo sapiens
MVSSCCGSVCSDQGCSQDLCQETCCRPSCCQTTCCRTTCYRPSCCVSSCCRPQCCQSVCCQPTCCRPTCCETTCCHPRCCISSCCRPSCCMSSCCKPQCCQSVCCQPTCCRPSCCRPCCCLRPVCGRVSCHTTCYRPTCVISTCPRPLCCASSCC

SEQ ID NO: 13229 - protein, 219 aa, Homo sapiens
MGCCGCSGGCGSGCGGCGSGCGGCGSGCGGCGSGCGGCGSGCGGCGSSCCVPICCCKPVCCCVPACSCSSCGSCGGSKGGYGSCGGSKGGCVSCGGSKGGCGSCGGSKGGCGSCGGSKGGCGSCGGSKGGCGSCGCSQCSCCKPCCFSSGCGSSCCQSSCCKPSCCQSSCCKPYCCQSSCCKPCCSSSGCGSSCCQSSCCNPCCSQSSCCVPVCCQCKI

SEQ ID NO: 13230 - protein, 228 aa, Homo sapiens
MGCCGCSGGCGSGCGGCGSGCGGCGSGCGGCGSGCGGCGSGCGGCGSSCCVPICCCKPVCCCVPACSCSSCGSCGGSKGGYGSCGGSKGGCVSCGGSKGGCGSCGGSKGGCGSCGGSKGGCGSCGGSKGGCGSCGCSQCSCCKPCCFSSGCGSSCCQSSCCKPCCSSSGCGSSCCQSSCCKPYCCQSSCCKPCCSSSGCGSSCCQSSCCNPCCSQSSCCVPVCCQCKI

SEQ ID NO: 13231 - protein, 116 aa, Homo sapiens [sequence omitted]

SEQ ID NO: 13232 - protein, 101 aa, Homo sapiens
RPFCCHTPCCQPSCCVPSCCQPCCHPTCCQNTCCRTTCCQPTCVASCCQPSCCSTPCCQPTCCGQTCNESSYCLPCCRPTCCQTTCYRTTCCRPSCCCSPC

SEQ ID NO: 13233 - protein, 250 aa, Homo sapiens
MTHCCSPCCQPTCCRTTCCRTTCWKPTTVTTCSSTPCCQPSCCVPSCCQPCCHPTCCQNTCCRTTCCQPTCVASCCQPSCCSTPCCQPTCCGSSCCGQTSCGSSCCQPICGSSCCQPCCHPTCYQTICFRTTCCQPTCCQPTCCRNTSCQPTCCGSSCCQPCCHPTCCQTICRSTCCQPSCVTRCCSTPCCQPTCGGSSCCSQTCNESSYCLPCCRPTCCQTTCYRTTCCRPSCCCSPCCVSSCCQPSCC

SEQ ID NO: 13234 - protein, 160 aa, Homo sapiens
MTHCCSPGCQPTCCRTTCCRTTCWQPTIVTTCSSTPCCQPSCCVSSCCQPYCHPTCCQNTCCRTTCCQPTCVTSCCQPSCCSTPCYQPICCGSSCCGQTSCGSSCGQSSSCAPVYCRRTCYHPTTVCLPGCLNQSCGSSCCQPCYCPACCVSSCCQHSCC

SEQ ID NO: 13235 - protein, 169 aa, Homo sapiens
MTHCCSPCCQPTCCRTTCWKPTTVTTCSSTPCCQPSCCVSSCCQPCCHPTCCQNTCCRTTCCQPTCVTSCCQPSCCSTPCCQPICCGSSCCGQTSCGSSCCQPSSCAPIYCRRTCYHPTSVYLPGCLNQSCGSSCCQPCCRPACCETTCCRTTCFQPTCVTSCCQPACC

SEQ ID NO: 13236 - protein, 169 aa, Homo sapiens
MTHCCSPCCQPTCCRTTCWKPTTVTTCSSTPCCQPSCCVSSCCQPCCRPACCQNTCCRTTCCQPTCLTSCCQPSCCSTTCCQPICCGSSCCGQTSCGSSCGQSSSCAPVYCRRTCYYPTTVCLPGCLNQSCGSSCCQPCCRPACCETTCCRTTCFQPTCVSSCCQPSCC

SEQ ID NO: 13237 - protein, 175 aa, Homo sapiens
MTHCCSPCCQPTCCRTTCCRTTCWKPTTVTTCSSTPCCQPSCCVSSCCQPPCCRPACCQNTCCRTTCCQPTCLTSCCQPSCCSTTCCQPICCGSSCCGQTSCGSSCGQSSSCAPVYCRRTCYYPTTVCLPGCLNQSCGSSCCQPCCRPACCETTCCRTTCFQPTCVSSCCQPSCC

SEQ ID NO: 13238 - protein, 678 aa, Homo sapiens
MPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRVEELAERLSWDFTPGPSSGASQCTGVLRDFSALLQSPGDAHREALLQLPLAVQEELLSLVQEASSGQGPGALASWEGRSSALLGAQCQGVRAPPSDGRESLDTGSMGPGDCRGARGDTYAVEKEGGKQGGPREMDWGWKELPGEEAWEREVALRPQSVGGGARESAPLKGKALGKEEIALGGGGFCVHREPPGAHGSCHRAAQSRGASLLQRLHNGNASPPRVPSPPPAPEPPWHCGDRGDCGDRGDVGDRGDKQQGMARGRGPQWKRGARGGNLVTGTQRFKEALQDPFTLCLANVPGQPDLRHIVIDGSNVAMVHGLQHYFSSRGIAIAVQYFWDRGHRDITVFVPQWRFSKDAKVRESHFLQKLYSLSLLSLTPSRVMDGKRISSYDDRFMVKLAEETDGIIVSNDQFRDLAEESEKWMAIIRERLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 13239 - protein, 678 aa, Homo sapiens; identical to SEQ ID NO: 13238

SEQ ID NO: 13240 - protein, 135 aa, Homo sapiens
MPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRV

SEQ ID NO: 13241 - protein, 678 aa, Homo sapiens; identical to SEQ ID NO: 13238

SEQ ID NO: 13242 - protein, 128 aa, Homo sapiens
MAVGTSALSKEPWWTLPENFHSPMVFHMEEDQEELIFGLDDTYLRCIELHSHTLIQLERCFTATGQTRVTVVGPPMAKQWLLLMFHCVGSQDSKCHARGLKMLERVRSQPLTNDDLVTSVSLPPYTGD

SEQ ID NO: 13243 - protein, 416 aa, Homo sapiens
MSPSHVVVNVSTARSGPLTTSSAPVSRAESLRPGSRSCTMSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 13244 - protein, 304 aa, Homo sapiens
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 13245 - protein, 304 aa, Homo sapiens; identical to SEQ ID NO: 13244

SEQ ID NO: 13246 - protein, 288 aa, Homo sapiens
MACVAFFLLQGAWPHEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGPKVNRTFQADFPLDPATHGGTYRCFGSFRDSPYEWSKSSDPLLVSVTGNSSNSWPSPTEPSSETGNPRHLHVLIGTSVVKLPFTILLFFLLHRWCSNKKNASVMDQGPAGNRTVNREDSDE

SEQ ID NO: 13247 - protein, 221 aa, Homo sapiens
MSLTVVSMACVGFFLLQGAWPLMGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVT

SEQ ID NO: 13248 - protein, 333 aa, Homo sapiens
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKS

SEQ ID NO: 13249 - protein, 1749 aa, Homo sapiens
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKIYRRSLCVLQAWVEDCYAVDFPRNSGLLGKLEDFISSKILPLDGSAKHLLGLLEVGMDRRAEGNPRGTDLENPREAEEDARPFNALCKRLSEDGISRKSFPWRLPRGNGLVLPPHKERPYTIAAALPKPCFLEDFYGPCAKTSEKGPYFLTEYSTHQLFSQLTLLQQELFQKCHPVHFLNSRALGVMDKSTAIPKASSSESLSAKTCSLFLPNYVQDKYLLQLLRNADDVSTWVAAEIVTSHTSKLQVNLLSKFLLIAKSCYEQRNFATAMQILSGLEHLAVRQSPAWRILPAKIAEVMEELKAVEVFLKSDSLCLMEGRRFRAQPTLPSAHLLAMHIQQLETGGFTMTNGAHRWSKLRNIAKVVSQVHAFQENPYTFSPDPKLQSYLKQRIARFSGADISTLAADSRANFHQVSSEKHSRKIQDKLRRMKATFQ

SEQ ID NO: 13250 - protein, 1751 aa, Homo sapiens
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMEPGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKIYRRSLCVLQAWVEDCYAVDFPRNSGLLGKLEDFISSKILPLDGSAKHLLGLLEVGMDRRAEGNPRGTDLENPREAEEDARPFNALCKRLSEDGISRKSFPWRLPRGNGLVLPPHKERPYTIAAALPKPCFLEDFYGPCAKTSEKGPYFLTEYSTHQLFSQLTLLQQELFQKCHPVHFLNSRALGVMDKSTAIPKASSSESLSAKTCSLFLPNYVQDKYLLQLLRNADDVSTWVAAEIVTSHTSKLQVNLLSKFLLIAKSCYEQRNFATAMQILSGLEHLAVRQSPAWRILPAKIAEVMEELKAVEVFLKSDSLCLMEGRRFRAQPTLPSAHLLAMHIQQLETGGFTMTNGAHRWSKLRNIAKVVSQVHAFQENPYTFSPDPKLQSYLKQRIARFSGADISTLAADSRANFHQVSSEKHSRKIQDKLRRMKATFQ

SEQ ID NO: 13251 - protein, 186 aa, Homo sapiens
  MOD_RES (1)..(1): Any amino acid
XDLSKSRENLSAVMLYNPGLFPIKGPICLRLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRL

SEQ ID NO: 13252 - protein, 957 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 13253 - protein, 687 aa, Homo sapiens
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 13254 - protein, 851 aa, Homo sapiens
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 13255 - protein, 859 aa, Homo sapiens
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTAPPLSSPPGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 13256 - protein, 851 aa, Homo sapiens; identical to SEQ ID NO: 13254

SEQ ID NO: 13257 - protein, 821 aa, Homo sapiens
MAKFALNQNLPDLGGPRLCPVPAAGGARSPSSPYSVETPYGFHLDLDFLKYIEELERGPAARRAPGPPTSRRPRAPRPGLAGARSPGAWTSSESLASDDGGAPGILSQGAPSGLLMQPLSPRAPVRNPRVEHTLRETSRRLELAQTHERAPSPGRGVPRSPRGSGRSSPAPNLAPASPGPAQLQLVREQMAAALRRLRELEDQARTLPELQEQVRALRAEKARLLAGRAQPEPDGEAETRPDKLAQLRRLTERLATSERGGRARASPRADSPDGLAAGRSEGALQVLDGEVGSLDGTPQTREVAAEAVPETREAGAQAVPETREAGVEAAPETVEADAWVTEALLGLPAAAERELELLRASLEHQRGVSELLRGRLRELEEAREAAEEAAAGARAQLREATTQTPWSCAEKAAQTESPAEAPSLTQESSPGSMDGDRAVAPAGILKSIMKKRDGTPGAQPSSGPKSLQFVGVLNGEYESSSSEDASDSDGDSENGGAEPPGSSSGSGDDSGGGSDSGTPGPPSGGDIRDPEPEAEAEPQQVAQGRCELSPRLREACVALQRQLSRPRGVASDGGAVRLVAQEWFRVSSQRRSQAEPVARMLEGVRRLGPELLAHVVNLADGNGNTALHYSVSHGNLAIASLLLDTGACEVNRQNRAGYSALMLAALTSVRQEEEDMAVVQRLFCMGDVNAKASQTGQTALMLAISHGRQDMVATLLACGADVNAQDADGATALMCASEYGRLDTVRLLLTQPGCDPAILDNEGTSALAIALEAEQDEVAALLHAHLSSGQPDTQSESPPGSQTATPGEGECGDNGENPQVQ

SEQ ID NO: 13258 - protein, 210 aa, Homo sapiens
MATARTVAPSPRVAPRAPGMTAAGDPTRAPLALPAAGTSGTLSPRRRQSLSRWHRGGERRSLVVWRGGGCPPPGRRCPRSILSLSWPPLQVRAEPASEGGVRSAAAAAEPAPRSSDGGAVRLVAQEWFRVSSQRRSQAEPVARMLEGVRRLGPELLAHVVNLADGNGNTALHYSVSHGNLAIASLLLDTGQSQGRVGHQEMGGGRGQGLT

SEQ ID NO: 13259 - protein, 133 aa, Homo sapiens
MITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 13260 - protein, 367 aa, Homo sapiens
MEKTDEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 13261 - protein, 351 aa, Homo sapiens
MKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 13262 - protein, 995 aa, Homo sapiens
MEKTDAKDQSSQGDEEKDPPKSHPYSVETPYGFHLDLDFLKYVDDIEKGNTIKRIPIHRRAKQAKFSTLPRNFSLPDSGARPPAAPPLQNWSPVVPREASLGTQEQNQSPPLGNAPQASTSRSEVSYHRKALLAEATRQLEAAEPEDAELTFGSGRPQLLRASSMPATLLHSRASEEPGLSLGPPAPPALPPLQGEGSVCDGTFEPAEGLAGFHSSSPRASTRIPELVQEGAEPPEGVVKVPNHLPLPGPPFSFQNVLVVLEDKEDEHNAREAEVLFTPGSPTPSPPPLPSPIPENELLLEEIELNISEIPPPPPVEVDMRSIGIRVTEESLGLARVDPGSISSLKQQVSALEGELSGRTEELAQVRTALQQQEEEIKAREQRIRELEFTVAQLEGQFHQENAKDTQGQTDVMVNTDPVHGLLTRESCDKGIEVNLLGSMESESWGHRGEENGLLWGPDGHKQGNQSPAERVLLPQLSLPQGPEQVLTSSVHSFLSTELRIEEAGTEQEGGPQGGTRGAGGFLWGSDRKTPPAGREETSSNLPGKEHPGRPPSSPTDATIGQYVKKIQELLQEQWNCLEHGYPELASAIKQPASKLSSIQSQLLSSLNLLLSAYSAQAHPPKEPPASSSSPPVEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 13263 - protein, 128 aa, Homo sapiens
MMTAVSLTTRPQESVAFEDVAVYFTTKEWAIMVPAERALYRDVMLENYEAVAFVVPPTSKPALVSHLEQGKESCFTQPQGVLSRNDWRAGWIGYLELRRYTYLAKAVLRRIVSKIFRNRQCWEDRRKA

SEQ ID NO: 13264 - protein, 128 aa, Homo sapiens; identical to SEQ ID NO: 13263

SEQ ID NO: 13265 - protein, 128 aa, Homo sapiens; identical to SEQ ID NO: 13263

SEQ ID NO: 13266 - protein, 1029 aa, Homo sapiens
MRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPEAAAAREPCPLRGLLSCLPDGPTSQPHLATTPTDSSCSSGPTGDGVQGSPLPIKTADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAPRGTPTSFSSSSSTDWDLDFGSPVGNQGQHPGKGSPPGSSPLQGLENCLKEIPVPVLRPAWPCSSAADRGPRRAEPRNWTADKEGLRAEACESRLGQGRGEAPTRSLHLVSPQVFTSSCVPACHQRGFKDPGATRPGVWRWLPEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYCSGLGAGTAQDPCPVSQLEKRPRVSEASRGLELGHGRPRVAAKTHERLLPQGPPELPSESPPPELPPPEAAPPVLPASSLQPPCHCGKPLQQELHSLGAALAEKLDRLATALAGLAQEVATMRTQVNRLGRRPQGPGPMGQASWMWTLPRGPRWAHGPGHRHLPYWRQKGPTRPKPKILRGQGESCRAGDLQGLSRGTARRARPLPPDAPPAEPPGLHCSSSQQLLSSTPSCHAAPPAHPLLAHTGGHQSPLPPLVPAALPLQGASPPAASADADVPTSGVAPDGIPERPKEPSSLLGGVQRALQEELWGGEHRDPRWGAH

SEQ ID NO: 13267 - protein, 969 aa, Homo sapiens
MRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPEAAAAREPCPLRGLLSCLPDGPTSQPHLATTPTDSSCSSGPTGDGVQGSPLPIKTADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAPRGTPTSFSSSSSTDWDLDFGSPVGNQGQHPGKGSPPGSSPLQGLENCLKEIPVPVLRPAWPCSSAADRGPRRAEPRNWTADKEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYCSGLGAGTAQDPCPVSQLEKRPRVSEASRGLELGHGRPRVAAKTHERLLPQGPPELPSESPPPELPPPEAAPPVLPASSLQPPCHCGKPLQQELHSLGAALAEKLDRLATALAGLAQEVATMRTQVNRLGRRPQGPGPMGQASWMWTLPRGPRWAHGPGHRHLPYWRQKGPTRPKPKILRGQGESCRAGDLQGLSRGTARRARPLPPDAPPAEPPGLHCSSSQQLLSSTPSCHAAPPAHPLLAHTGGHQSPLPPLVPAALPLQGASPPAASADADVPTSGVAPDGIPERPKEPSSLLGGVQRALQEELWGGEHRDPRWGAH

SEQ ID NO: 13268 - protein, 103 aa, Homo sapiens
MRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPE

SEQ ID NO: 13269 - protein, 492 aa, Homo sapiens
MPSFLVPSLVSSPVLLKLLFSPGPKTIWSLWQQPMLFQEATAFENMTKDWNYLEGSQKDCYRDTMLDSYENTVPQGSFLQLSMMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 13270 - protein, 410 aa, Homo sapiens
MMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 13271 - protein, 709 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEEGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 13272 - protein, 582 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEEGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGEAQVGRPWVGRGHRGAWHSPAAWLCLEQGTRRSRSTWMSITGWTTRTSSTTCPVASSTAQWCPVTLASALRRSSLLTIRS

SEQ ID NO: 13273 - protein, 354 aa, Homo sapiens
MPLVVFCGLPYSGKSRRAEELRVALAAEGRAVYVVDDAAVLGAEDPAVYGDSAREKALRGALRASVERRLSRHDVVILDSLNYIKGFRYELYCLARAARTPLCLVYCVRPGGPIAGPQVAGANENPGRNVSVSWRPRAEEDGRAQAAGSSVLRELHTADSVVNGSAQADVPKELEREESGAAESPALVTPDSEKSAKHGSGAFYSPELLEALTLRFEAPDSRNRWDRPLFTLVGLEEPLPLAGIRSALFENRAPPPHQSTQSQPLASGSFLHQLDQVTSQVLAGLMEAQKSAVPGDLLTLPGTTEHLRFTRPLTMAELSRLRRQFISYTKMHPNNENLPQLANMFLQYLSQSLH

SEQ ID NO: 13274 - protein, 53 aa, Homo sapiens
MEAAGGFQVHFHPSNGDGRFIETSSAADLEVISYSSKVSVTERCFIKVCTVLF

SEQ ID NO: 13275 - protein, 53 aa, Homo sapiens; identical to SEQ ID NO: 13274

SEQ ID NO: 13276 - protein, 176 aa, Homo sapiens
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDTSPDTVSPSLSPGFEDLSHVQPGSPAINGRSQTDDEEMTGE

SEQ ID NO: 13277 - protein, 176 aa, Homo sapiens; identical to SEQ ID NO: 13276

SEQ ID NO: 13278 - protein, 176 aa, Homo sapiens; identical to SEQ ID NO: 13276

SEQ ID NO: 13279 - protein, 143 aa, Homo sapiens
MRDADADAGGGADGGDGRGGHSCRGGVDTAAAPAGGAPPAHAPGPGRDAASAARGSRMRPHIFTLSVPFPTPLEAEIAHGSLAPDAEPHQRVVGKDLTVSGRILVVRWKAEDCRLLRISVINFLDQLSLVVRTMQRFGPPVSR

SEQ ID NO: 13280 - protein, 1248 aa, Homo sapiens
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 13281 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 13282 - protein, 445 aa, Homo sapiens
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGR

SEQ ID NO: 13283 - protein, 855 aa, Homo sapiens
MENWPTPSELVNTGFQSVLSQGNKKPQNRKEKEEKVEKRSNSDSKENRETKLNGPGENVSEDEAQSSNQRKRGWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKQEVENFKKLNLISKEQFENLTPELPFEPNQEVPVAPSQSRQDLTDELAQKLFDVSEITSAAMVHSLPTAVPESPRIHPTRTPKTPRTPRLQDPNKTPRFYPVVKEPKAIDVKSPRKRKTRHSTNPPLECHVGWVMDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 13284 - protein, 914 aa, Homo sapiens
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKQEVENFKKLNLISKEQFENLTPELPFEPNQEVPVAPSQSRQGGVQGVLHIPKKDLTDELAQKLFDVSEITSAAMVHSLPTAVPESPRIHPTRTPKTPRTPRLQDPNKTPRFYPVVKEPKAIDVKSPRKRKTRHSTNPPLECHVGWVMDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 13285 - protein, 281 aa, Homo sapiens
MVHSLPTAVPESPRIHPTRTPKTPRTPRLQDPNKTPRFYPVVKEPKAIDVKSPRKRKTRHSTNPPLECHVGWVMDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDNHHDRLLLLIINI

SEQ ID NO: 13286 - protein, 335 aa, Homo sapiens
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 13287 - protein, 522 aa, Homo sapiens
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKVIVSGQHLSTDALF

SEQ ID NO: 13288 - protein, 358 aa, Homo sapiens
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTGNIFSSRANDVTVGYLVQFTYLFIYFQFI

SEQ ID NO: 13289 - protein, 787 aa, Homo sapiens
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKQEVENFKKLNLISKEQFENLTPELPFEPNQEVPVAPSQSRQGGVQGVLHIPKKDLTDELAQKLFDVSEITSAAMVHSLPTAVPESPRIHPTRTPKTPRTPRLQDPNKTPRFYPVVKEPKAIDVKSPRKRKTRHSTNPPLECHVGWVMDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRSAVWTRKVLGLFEIFSI

SEQ ID NO: 13290 - protein, 491 aa, Homo sapiens
  MOD_RES (1)..(1): Any amino acid
XEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKVIVSGQHLSTDALF

SEQ ID NO: 13291 - protein, 653 aa, Homo sapiens
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 13292 - protein, 653 aa, Homo sapiens
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 13293 - protein, 374 aa, Homo sapiens [sequence omitted]

SEQ ID NO: 13294 - protein, 724 aa, Homo sapiens
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 13295 - protein, 730 aa, Homo sapiens
MLLFVEQVASKGTGLNPNAKVWQEIAPGNTDATPVTHGTESSWHEIAATSGAHPEVSVFNTGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 13296 - protein, 188 aa, Homo sapiens
MYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFILKRRS

SEQ ID NO: 13297 - protein, 723 aa, Homo sapiens
MLLFVEVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 13298 - protein, 738 aa, Homo sapiens
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEEVEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 13299 - protein, 131 aa, Homo sapiens
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGP

SEQ ID NO: 13300 - protein, 57 aa, Homo sapiens
MTSDQDAKVVAEPQTQRVQEGKDSAHLMNGPISQTTSQTSSIPPLSQVPATKVSELN

SEQ ID NO: 13301 - protein, 183 aa, Homo sapiens
  MOD_RES (1)..(1): Any amino acid
XSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATVRTSCLPSCTTAARLWCEQTLRTPAPARFLITSNLVGFYLRLSVLCFLYKIPLIFANNFPLTTL

SEQ ID NO: 13302 - protein, 339 aa, Homo sapiens
  MOD_RES (1)..(1): Any amino acid
XSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATVRTSCLPSCTTAARLWCEQTLRTPAPARFLITSNLELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 13303 - protein, 430 aa, Homo sapiens
MAEAVLIDLFGLKLNSQKNCHQTLLKTLNAVQYHHAAKAKFLCIMCCSNISYERDGEQDNCEIETSNGLSALLEEFEIVSCPSMAATLYTIKQKIDEKNLSSIKVIVPRHRKTLMKAFIDQLFTDVYNFEFEDLQVTFRGGLFKQSIEINVITAQELRGIQNEIETFLRSLPALRGKLTIITSSLIPDIFIHGFTTRTGGISYIPTLSSFNLFSSSKRRDPKVVVQENLRRLANAAGFNVEKFYRIKTHHSNDIWIMGRKEPDSYDGITTNQRGVTIAALGADCIPIVFADPVKKACGVAHAGWKGTLLGVAMATVNAMIAEYGCSLEDIVVVLGPSVGPCCFTLPRESAEAFHNLHPACVQLFDSPNPCIDIRKATRILLEQGGILPQNIQDQNQDLNLCTSCHPDKFFSHVRDGLNFGTQIGFISIKE

SEQ ID NO: 13304 - protein, 164 aa, Homo sapiens
MAEAVLIDLFGLKLNSQKNCHQTLLKTLNAVQYHHAAKAKFLCIMCCSNISYERDGEQDNCEIETSNGLSALLEEFEIVSCPSMAATLYTIKQKIDEKNLSSIKVIVPRHRKTLMKAFIDQLFTDVYNFEFEDLQVTFRGGLFKQSIEINVITAQELRGIQNEI

SEQ ID NO: 13305 - protein, 430 aa, Homo sapiens; identical to SEQ ID NO: 13303

SEQ ID NO: 13306 - protein, 1823 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 13307 - protein, 120 aa, Homo sapiens
MALSSAWRSVLPLWLLWSAACSRAASGDDNAFPFDIEGSSAVGRQDPPETSEPRVALGRLPPAAEVQCPCHCHPAGAPAPPRAVPHSSFSLSPPLSSPQCLESFTWARSVRKLEIKSFPL

SEQ ID NO: 13308 - protein, 420 aa, Homo sapiens
MDTKRCFANRFDDYQGSLLAGQCEEAVAPLVTATIERILQELPPLGGGAEARGATAGASACQGGLYGGVAGVAYMLYHVSQSPLFATARERYLRSAKRLIDACARAEEWGEPDADTRAAFLLGGAGVYAVATLVYHALGRSDYVQPLGKFRALCAVCAPVSFLECGSDELFVGRAGYLCAALVLKQKLAQEVLTPAQIKSICQAILDSGKQYAIKKRKPFPLMYSYYGTEYLGAAHGLSSILQMLLSYHEHLKPSDRELVWQSVDFLMEQEQNCNWPPELGETIERENELVHWCHGAPGIAYLFAKAYLVSKKPQYLDTCIRCGELTWQKGLLKKGPGICHGVAGSAYVFLLLYRLTGNSKYIYRAQRFAQFLFTEEFKAGSRVLESIYSLYEGFSGTVCFLIDLLQPNQAEFPLFSVFV

SEQ ID NO: 13309 - protein, 388 aa, Homo sapiens
MDTKRCFANRFDDYQGSLLAGQCEEAVAPLVTATIERILQELPPLGGGAEARGATAGASACQGGLYGGVAGVAYMLYHVSQSPLFATARERYLRSAKRLIDACARAEEWGEPDADTRAAFLLGGAGVYAVATLVYHALGRSDYVQPLGKFRALCAVCAPVSFLECGSDELFVGRAGYLCAALVLKQKLAQEVLTPAQIKSICQAILDSGKQYAIKKRKPFPLMYSYYGTEYLGAAHGLSSILQMLLSYHEHLKPSDRELVWQSVDFLMEQEQNCNWPPELGETIERENELVHWCHGAPGIAYLFAKAYLVSKKPQYLDTCIRCGELTWQKGLLKKGPGICHGVAGSAYVFLLLYRLTGNSKYIYRAQSSFPVNLIKMEHLLYTRQHCF

SEQ ID NO: 13310 - protein, 80 aa, Homo sapiens
MSQQKQQSWKPPNVPKCSPPQRSNPCLAPYSTPCGAPHSEGCHSSSQRPEVQKPRRARQKLRCLSRGTTYHCKEEECEGD

SEQ ID NO: 13311 - protein, 1469 aa, Homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 13312 - protein, 670 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKGQKEISVEKKHTWNASLFNSQIHMIAQRRDAMAHRILSARLHKIKGLKNELADMHHKLEAILTENQFLKQLQLRHLKAIGKYENSQNNLPQIMAKHQNEVKNLRQLLRKSQEKERTLSRKLRETDSQLLKTKDILQALQKLSEDKNLAEREELTHKLSIITTKMDANDKKIQSLEKQLRLNCRAFSRQLAIETRKTLAAQTATKTLQVEVKHLQQKLKEKDRELEIKNIYSHRILKNLHDTEDYPKVSSTKSVQADRKILPFTSMRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSSPTEGKRKIII

SEQ ID NO: 13313 - protein, 670 aa, Homo sapiens; identical to SEQ ID NO: 13312

SEQ ID NO: 13314 - protein, 670 aa, Homo sapiens; identical to SEQ ID NO: 13312

SEQ ID NO: 13315 - protein, 93 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEK

SEQ ID NO: 13316 - protein, 69 aa, Homo sapiens
MSLADLTKTNIDEHFFGVALENNRRSAACKRSPGTGDFSRNSNASNKSVDYSRSQCSCGSLSSQYDYSE

SEQ ID NO: 13317 - protein, 189 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKGQKEISVEKKHTWNASLFNSQIHMIAQRRDAMAHRILSARLHKIKGLKNELADMHHKLEAILTENQFLKQLQLRHLKAIGKY

SEQ ID NO: 13318 - protein, 63 aa, Homo sapiens
MSLADLTKTNIDEHFFGVALENNRRSAACKRSPGTGDFSRNSNASNKSVDYSRSQCSCGSLSS

SEQ ID NO: 13319 - protein, 95 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEKEK

SEQ ID NO: 13320 - protein, 94 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEKE

SEQ ID NO: 13321 - protein, 108 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKG

SEQ ID NO: 13322 - protein, 10 aa, Homo sapiens
MSLADLTKTN

SEQ ID NO: 13323 - protein, 30 aa, Homo sapiens
MSLADLTKTNIDEHFFGVALENNRRSAACK

SEQ ID NO: 13324 - protein, 142 aa, Homo sapiens
MSFLTVPYKLPVSLSVGSCVIIKGTLIDSSINEPQLQVDFYTEMNEDSEIAFHLRVHLGRRVVMNSREFGIWMLEENLHYVPFEDGKPFDLRIYVCLNEYEVKVNGEYIYAFVHRIPPSYVKMIQVWRDVSLDSVLVNNGRR

SEQ ID NO: 13325 - protein, 356 aa, Homo sapiens
MAFSGSQAPYLSPAVPFSGTIQGGLQDGFQITVNGAVLSSSGTRFAVDFQTGFSGNDIAFHFNPRFEDGGYVVCNTRQKGRWGPEERKMHMPFQKGMPFDLCFLVQSSDFKVMVNGSLFVQYFHRVPFHRVDTISVNGSVQLSYISFQNPRTVPVQPAFSTVPFSQPVCFPPRPRGRRQKPPSVRPANPAPITQTVIHTVQSASGQMFSQTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 13326 - protein, 355 aa, Homo sapiens
MAFSGSQAPYLSPAVPFSGTIQGGLQDGFQITVNGAVLSSSGTRFAVDFQTGFSGNDIAFHFNPRFEDGGYVVCNTRQKGRWGPEERKMHMPFQKGMPFDLCFLVQSSDFKVMVNGSLFVQYFHRVPFHRVDTISVNGSVQLSYISFQNPRTVPVQPAFSTVPFSQPVCFPPRPRGRRQKPPSVRPANPAPITQTVIHTVQSASGQMFSTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 13327 - protein, 356 aa, Homo sapiens
MAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKVMVNGSLFVQYFHRVPFHRVDTISVNGSVQLSYISFQNPRAVPVQPAFSTVPFSQPVCFPPRPRGRRQKPPSVRPANPAPITQTVIHTVQSASGQMFSQTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 13328 - protein, 268 aa, Homo sapiens
MHMPFQKGMPFDLCFLVQSSDFKVMVNGSLFVQYFHRVPFHRVDTISVNGSVQLSYISFQNPRAVPVQPAFSTVPFSQPVCFPPRPRGRRQKPPSVRPANPAPITQTVIHTVQSASGQMFSQTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 13329 - protein, 172 aa, Homo sapiens
MAGSVADSDAVVKLDDGHLNNSLSSPVQADVYFPRLIVPFCGHIKGGMRPGKKVLVMGIVDLNPESFAISLTCGDSEDPPADVAIELKAVFTDRQLLRNSCISGERGEEQSAIPYFPFIPDQPFRVEILCEHPRFRVFVDGHQLFDFYHRIQTLSAIDTIKINGDLQITKLG

SEQ ID NO: 13330 - protein, 498 aa, Homo sapiens
MSTFGYRRGLSKYESIDEDELLASLSAEELKELERELEDIEPDRNLPVGLRQKSLTEKTPTGTFSREALMAYWEKESQKLLEKERLGECGKVAEDKEESEEEEDSDEEERTIETAKGINGTVNYDSVNSDNSKPKIFKSQIENINLTNGSNGRNTESPAAIHPCGNPTVIEDALDKIKSNDPDTTEVNLNNIENITTQTLTRFAEALKDNTVVKTFSLANTHADDSAAMAIAEMLKVNEHITNVNVESNFITGKGILAIMRALQHNTVLTELRFHNQRHIMGSQVEMEIVKLLKENTTLLRLGYHFELPGPRMSMTSILTRNMDKQRQKRLQEQKQQEGYDGGPNLRTKVWQRGTPSSSPYVSPRHSPWSSPKLPKKVQTVRSRPLSPVATPPPPPPPPLPEKKLITRNIAEVIKQQESAQRALQNGQKKKKGKKVKKQPNSILKEIKNSLRSVQEKKMEDSSRPSTPQRSAHENLMEAIRGSSIKQLKRVEVPEALR

SEQ ID NO: 13331 - protein, 507 aa, Homo sapiens
MSTFGYRRGLSKYESIDEDELLASLSAEELKELERELEDIEPDRNLPVGLRQKSLTEKTPTGTFSREALMAYWEKESQKLLEKERLGECGKVAEDKEERTIETAKGINGTVNYDSVNSDNSKPKIFKSQIENINLTNGSNGRNTESPAAIHPCGNPTVIEDALDKIKSNDPDTTEVNLNNIENITTQTLTRFAEALKDNTVVKTFSLANTHADDSAAMAIAEMLKVNEHITNVNVESNFITGKGILAIMRALQHNTVLTELRFHNQRHIMGSQVEMEIVKLLKENTTLLRLGYHFELPGPRMSMTSILTRNMDKQRQKRLQEQKQQEGYDGGPNLRTKVWQRGTPSSSPYVSPRHSPWSSPKLPKKVQTVRSRPLSPVATPPPPPPPPPPPPPSSQRLPPPPPPPPPPLPEKKLITRNIAEVIKQQESAQRALQNGQKKKKGKKVKKQPNSILKEIKNSLRSVQEKKMEDSSRPSTPQRSAHENLMEAIRGSSIKQLKRVEVPEALR

SEQ ID NO: 13332 - protein, 547 aa, Homo sapiens
MSTFGYRRGLSKYESIDEDELLASLSAEELKELERELEDIEPDRNLPVGLRQKSLTEKTPTGTFSREALMAYWEKESQKLLEKERLGECGKVAEDKEESEEELIFTESNSEVSEEVYTEEEEEESQEEEEEEDSDEEERTIETAKGINGTVNYDSVNSDNSKPKIFKSQIENINLTNGSNGRNTESPAAIHPCGNPTVIEDALDKIKSNDPDTTEVNLNNIENITTQTLTRFAEALKDNTVVKTFSLANTHADDSAAMAIAEMLKVNEHITNVNVESNFITGKGILAIMRALQHNTVLTELRFHNQRHIMGSQVEMEIVKLLKENTTLLRLGYHFELPGPRMSMTSILTRNMDKQRQKRLQEQKQQEGYDGGPNLRTKVWQRGTPSSSPYVSPRHSPWSSPKLPKKVQTVRSRPLSPVATPPPPPPPPPPPPPSSQRLPPPPPPPPPPLPEKKLITRNIAEVIKQQESAQRALQNGQKKKKGKKVKKQPNSILKEIKNSLRSVQEKKMEDSSRPSTPQRSAHENLMEAIRGSSIKQLKRVEVPEALR

SEQ ID NO: 13333 - protein, 735 aa, Homo sapiens
MLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 13334 - protein, 1004 aa, Homo sapiens
MHGSCCLGGGQPLSVFASLHMGPEGLALKAGRGWCPTFQSFPEPTPSYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAATFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERAATGVHIEPPWGAASAMAEQSEWLSVQAAR

SEQ ID NO: 13335 - protein, 686 aa, Homo sapiens
MGPRSRERRAGAVQNTNDSSALSKRSLAARGYVQDPFAALLVPGAARRAPLIHRGYYVRARAVRHCVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 13336 - protein, 265 aa, Homo sapiens
MTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 13337 - protein, 132 aa, Homo sapiens
MDHHIPMHALPEEIQKMLPEEKVCKYCGVSYLILHEFKAMEEKVKAMEKEMKFYQGSVDREKRLQEKLHSLSQELEQYKIDNKSKTERIYDVGMQLKSQQNEFQKVKKQLSHLQDELKIKYRQSYIFRLCFC

SEQ ID NO: 13338 - protein, 292 aa, Homo sapiens
MGIAESTPDELPSDAEEQLRSGDQQLELSGRRLRRLPSAVCALSRLQKLYVSGTGLRELPEEIEELRELRILALDFNKLERLPDGLCRLPRLTRLYLGGNRLLALPADFAQLQSLRCLWIEGNFLRRFPRPLLRLVALQSLQMGDNRLRALPAELPRMTGLRGLWLYGNRFEEFPPALLRMGRLHILDLDRNRLGGFPDLHPLRALRVFSYDHNPVTGPPRVADTVFLVGEGAVERMAERDEPTPRPPPRRPARAFEDEEEEDLLIGGAGSRALGAPGGSFRALEAAPGLGT

SEQ ID NO: 13339 - protein, 493 aa, Homo sapiens
MHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPGPAPIPVEVRVDLRVNRASYAFLREALRSSVGSPLRLCCRDLRAEDLPMRNTVALLQLLDAGCLRRVDLRFNNLGLRGLSVIIPHVARFQHLASLRLHYVHGDSRQPSVDGEDNFRYFLAQMGRFTCLRELSMGSSLLSGRLDQLLSTLQSPLESLELAFCALLPEDLRFLARSPHAAHLKKLDLSGNDLSGSQLAPFQGLLQASAATLLHLELTECQLADTQLLATLPILTQCASLRYLGLYGNPLSMAGLKELLRDSVAQAELRTVVHPFPVDCYEGLPWPPPASVLLEASINEEKFARVEAELHQLLLASGRAHVLWTTDIYGRLAADYFSL

SEQ ID NO: 13340 - protein, 514 aa, Homo sapiens
MDTMRSLRFISAEALVSHPQVARQSLDSVAHNLYPLLFKASYLLEQAEVTRAVLGRWPLEEFRLGALLGPGADHPQDLRDRTCRACLEALVRGLADHVLQDRSRRRLRVADLTGIRDVQVQRCPCGRALGRWGRTQLLARTCCELQAEPLAAGRPVEVLADLFVTEGNFEAVVQALRPAGPAPLRVHCPSFRADSLSPSQLLHVLRLAGPGALRKLEVVHNVRLHAGHVQQLLAQVGFPRLASLTLPTKAFDAPPTYASTPDGEDPLLASIARELSKMAQLTELSVAFSTLTGKIPTLLGPLQTPLRVLDLANCALNHTDMAFLADCAHAAHLEVLDLSGHNLVSLYPSTFFRLLSQASRTLRILTLEECGIVDSHVGMLILGLSPCHRLRQLKFLGNPLSARALRRLFTALCELPELRCIEFPVPKDCYPEGAAYPQDELAMSKFNQQKYDEIAEELRAVLLRADREDIQVSTPLFGSFDPDIQETSNELGAFLLQAFKTALENFSRALKQIE

SEQ ID NO: 13341 - protein, 425 aa, Homo sapiens
MAIKKQKRCRKIRPVSAFISGSPQDMESQLGNLGIPPGWFSGLGGSQPTASGSWEGLSELPTHGYKLRHQTQGRPRPPRTTPPGPGRPSMPAPGTRQENGMATRLDEGLEDFFSRRVLEESSSYPRTLRTVRPGLSEAPLPPLQKKRRRGLFHFRRPRSFKGDRGPGSPTTGLLLPPPPPPPPTQESPPSPDPPSLGNNSSPCWSPEEESSLLPGFGGGRGPSFRRKMGPGPDQEGSTQAWQKRRSSDDAGPGSWKPPPPPQSTKPSFSAMRRAEATWHIAEESAPNHSCQSPSPASQDGEEEKEGTLFPERTLPARNAKLQDPALAPWPPKPVAVPRGRQPPQEPGVREEAEAGDAAPGVNKPRLRLSSQQDQEEPEVQGPPDPGRRTAPLKPKRTRRAQSCDKLEPDRRRPPDPTGTSEPGTD

SEQ ID NO: 13342 - protein, 1372 aa, Homo sapiens
MAKPSVELTRELQDSIRRCLSQGAVLQQHHVKLETKPKKFEDRVLALTSWRLHLFLLKVPAKVESSFNVLEIRAFNTLSQNQILVETERGMVSMRLPSAESVDQVTRHVSSALSKVCPGPGCLIRRGNADTPEGPRDTSPNSETSTSTTHSVCGGFSETYAALCDYNGLHCREEVQWDVDTIYHAEDNREFNLLDFSHLESRDLALMVAALAYNQWFTKLYCKDLRLGSEVLEQVLHTLSKSGSLEELVLDNAGLKTDFVQKLAGVFGENGSCVLHALTLSHNPIEDKGFLSLSQQLLCFPSGLTKLCLAKTAISPRGLQALGQTFGANPAFASSLRYLDLSKNPGLLATDEANALYSFLAQPNALVHLDLSGTDCVIDLLLGALLHGCCSHLTYLNLARNSCSHRKGREAPPAFKQFFSSAYTLSHVNLSATKLPLEALRALLQGLSLNSHLSDLHLDLSSCELRSAGAQALQEQLGAVTCVGSLDLSDNGFDSDLLTLVPALGKNKSLKHLFLGKNFNVKAKTLEEILHKLVQLIQEEDCSLQSLSVADSRLKLRTSILINALGSNTCLAKVDLSGNGMEDIGAKMLSKALQINSSLRTILWDRNNTSALGFLDIARALESNHTLRFMSFPVSDISQAYRSAPERTEDVWQKIQWCLVRNNHSQTCPQEQAFRLQQGLVTSSAEQMLQRLCGRVQEEVRALRLCPLEPVQDELLYARDLIKDAKNSRALFPSLYELGHVLANDGPVRQRLESVASEVSKAVDKELQVILESMVSLTQELCPVAMRVAEGHNKMLSNVAERVTVPRNFIRGALLEQAGQDIQNKLDEVKLSVVTYLTSSIVDEILQELYHSHKSLARHLTQLRTLSDPPGCPGQGQDLSSRGRGRNHDHEETTDDELGTNIDTMAIKKQKRCRKIRPVSAFISGSPQDMESQLGNLGIPPGWFSGLGGSQPTASGSWEGLSELPTHGYKLRHQTQGRPRPPRTTPPGPGRPSMPAPGTRQENGMATRLDEGLEDFFSRRVLEESSSYPRTLRTVRPGLSEAPLPPLQKKRRRGLFHFRRPRSFKGDRGPGSPTTGLLLPPPPPPPPTQESPPSPDPPSLGNNSSPCWSPEEESSLLPGFGGGRGPSFRRKMGTEGSEPGEGGPAPGTAQQPRVHGVALPGLERAKGWSFDGKREGPGPDQEGSTQAWQKRRSSDDAGPGSWKPPPPPQSTKPSFSAMRRAEATWHIAEESAPNHSCQSPSPASQDGEEEKEGTLFPERTLPARNAKLQDPALAPWPPKPVAVPRGRQPPQEPGVREEAEAGDAAPGVNKPRLRLSSQQDQEEPEVQGPPDPGRRTAPLKPKRTRRAQSCDKLEPDRRRPPDPTGTSEPGTD

SEQ ID NO: 13343 - protein, 184 aa, Homo sapiens
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 13344 - protein, 128 aa, Homo sapiens
MLKKMGEAVARVARKVNETVESGSDTLDLAECKLVSFPIGIYKVLRNVSGQIHLITLANNELKSLTSKFMTTFSQLRDVPVEKLAAMPALRSINLRFNPLNAEVRVIAPPLIKFDMLMSPEGARAPLP

SEQ ID NO: 13345 - protein, 134 aa, Homo sapiens
MLKKMGEAVARVARKVNETVESGSDTLELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 13346 - protein, 184 aa, Homo sapiens; identical to SEQ ID NO: 13343

SEQ ID NO: 13347 - protein, 128 aa, Homo sapiens; identical to SEQ ID NO: 13344

SEQ ID NO: 13348 - protein, 134 aa, Homo sapiens; identical to SEQ ID NO: 13345

SEQ ID NO: 13349 - protein, 175 aa, Homo sapiens
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMS

SEQ ID NO: 13350 - protein, 343 aa, Homo sapiens
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRGNMVANLGELAKLRDLPKLRALVLLDNPCTDETSYRQEALVQMPYLERLDKEFYEEEERAEADVIRQRLKEEKEQEPEPQRDLEPEQSLI

SEQ ID NO: 13351 - protein, 312 aa, Homo sapiens
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRRSKTLAFRPDQTPRGSHHMYDREQRMPVFAPKLEIHHNLRPRICSVPVLWAVWGAEWGA

SEQ ID NO: 13352 - protein, 94 aa, Homo sapiens
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLR

SEQ ID NO: 13353 - protein, 343 aa, Homo sapiens; identical to SEQ ID NO: 13350

SEQ ID NO: 13354 - protein, 343 aa, Homo sapiens; identical to SEQ ID NO: 13350

SEQ ID NO: 13355 - protein, 343 aa, Homo sapiens; identical to SEQ ID NO: 13350

SEQ ID NO: 13356 - protein, 383 aa, Homo sapiens
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRTRVPRKQALQRLHERKTRIMGVVGRAPTHMGEGRQPPPGASYPTSCHRTKWRSEQKDWKRAERRRSESSRRSRL

SEQ ID NO: 13357 - protein, 169 aa, Homo sapiens
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQERNHAESTEPKTLPSGIPSSARCAEGIGGYPALPADVGSRTLSPQKSNFSRGSTG

SEQ ID NO: 13358 - protein, 468 aa, Homo sapiens
MDINTYNNQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLIDNRKVPLNPPGKMKPSKEKSPQASKEMSALQERNLEEKIKQHVLQMREQRRFHGQAPLEEMRKAAEDLEIATELQDEVLKLKLGLTLNKDRRRAALTGNLSLGLPAAQPQNTFFNTKYGESGNVRRYQ

SEQ ID NO: 13359 - protein, 468 aa, Homo sapiens; identical to SEQ ID NO: 13358

SEQ ID NO: 13360 - protein, 530 aa, Homo sapiens
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLIDNRKVPLNPPGKMKPSKEKSPQASKEMSALQERNLEEKIKQHVLQMREQRRFHGQAPLEEMRKAAEDLEIATELQDEVLKLKLGLTLNKDRRRAALTGNLSLGLPAAQPQNTFFNTKYGESGNVRRYQ

SEQ ID NO: 13361 - protein, 530 aa, Homo sapiens; identical to SEQ ID NO: 13360

SEQ ID NO: 13362 - protein, 383 aa, Homo sapiens
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRRPFLLIFPRVFQALTRSSGRFILVLL

SEQ ID NO: 13363 - protein, 383 aa, Homo sapiens; identical to SEQ ID NO: 13356

SEQ ID NO: 13364 - protein, 368 aa, Homo sapiens
MLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLIDNRKVPLNPPGKMKPSKEKSPQASKEMSALQERNLEEKIKQHVLQMREQRRFHGQAPLEEMRKAAEDLEISRRWERGGMRAGCGATSWRPHPT

SEQ ID NO: 13365 - protein, 258 aa, Homo sapiens
  MOD_RES (1)..(1): Any amino acid
XFRTSVSTPSGNTDMDINTYNNQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRH

SEQ ID NO: 13366 - protein, 367 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 13367 - protein, 298 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 13368 - protein, 151 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPVPHCGPKSSMVCAAPSLPAAQPQ

SEQ ID NO: 13369 - protein, 312 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKGRQLLVLWLTAAPPSVCRLLTC

SEQ ID NO: 13370 - protein, 170 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLW

SEQ ID NO: 13371 - protein, 223 aa, Homo sapiens
MYSSGWPAGAAEPRHGRGRELAQALGCMHGAPSQLASLSLAHCSSLKSRPELEHQASGTKDACPEPQGPSLLTLRALQELDLTACSKLTDASLAKVLQFLQLRQLSLSLLPELTDNGLVAVARGCPSLEHLALSHCSRLSDKGWAQAASSWPRLQHLNLSSCSQLIEQTLDAIGQACRQLRVLDVATCPGINMAAVRRFQAQLPQVSCVQSRFVGGADLTLTL

SEQ ID NO: 13372 - protein, 223 aa, Homo sapiens; identical to SEQ ID NO: 13371

SEQ ID NO: 13373 - protein, 223 aa, Homo sapiens; identical to SEQ ID NO: 13371

SEQ ID NO: 13374 - protein, 223 aa, Homo sapiens; identical to SEQ ID NO: 13371

SEQ ID NO: 13375 - protein, 165 aa, Homo sapiens
MYSSGWPAGAAEPRHGRGRELAQALGCMHGAPSQLASLSLAHCSSLKSRPELEHQASGTKDACPEPQGPSLLTLRALQELDLTACSKLTDASLAKVLQFLQLRQLSLSLLPELTDNGLVAVARGCPSLEHLALSHCSRLSDKGWAQAASSWPRLQHLNLSSCSQL

SEQ ID NO: 13376 - protein, 301 aa, Homo sapiens
MGARQSRASSKDKGPKRMLFTGRRQKFSPWDDALLSGRDPRSLLKRGMHHVSFSLVTRGMTDIPDFLWGLSEVQKLNLSHNQLRVLPPEVGKLTRIVVLNLCGNRLKSLPREVSLLQCLKVLFVNMNCLTEVPAELSLCRKLEVLSLSHNCLSQLPACFADLSRLRKLNLSNNFFAHIPMCVFSLKELIFLHVGSNRLENIAESIQHLASLQIFIAEGNNIHSFPRSLCLVTSLELLNLNNNDIQTLPSELHLLCRLVRIAWNPMDKGLHISHNPLSKPLPELVEGGLEMLFGYLKDKKHT

SEQ ID NO: 13377 - protein, 496 aa, Homo sapiens
MSQTRKKTSSEGETKPQTSTVNKFLRGSNAESRKEDNDLKTSDSQPSDWIQKTATSETAKPLSSEMEWRSSMEKNEHFLQKLGKKAVNKCLDLNNCGLTTADMKEMGEAFEMIPELEELNLSWNSKVGGNLPLILQKFQKGSKIQMIELVDCSLTSEDGTFLGQLLPMLQSLEVLDLSINRDIVGSLNSIAQGLKSTSNLKVLKLHSCGLSQKSVKILDAAFRYLGELRKLDLSCNKDLGGGFEDSPAQLVMLKHLQVLDLHQCSLTADDVMSLTQVIPLLSNLQELDLSANKKMGSSSENLLSRLRFLPALKSLVINNCALESETFTALAEASVHLSALEVFNLSWNKCVGGNLKLLLETLKLSMSLQVLRLSSCSLVTEDVALLASVIQTGHLAKLQKLDLSYNDSICDAGWTMFCQNVRFLKELIELDISLRPSNFRDCGQWFRHLLYAVTKLPQITEIGMKRWILPASQEEELECFDQDKKRSIHFDHGGFQ

SEQ ID NO: 13378 - protein, 552 aa, Homo sapiens
MSQTRKKTSSEGETKPQTSTVNKFLRGSNAESRKEDNDLKTSDSQPSDWIQKTATSETAKPLSSEMEWRSSMEKNEHFLQKLGKKAVNKCLDLNNCGLTTADMKEMVALLPFLPDLEELDISWNGFVGGTLLSITQQMHLVSKLKILRLGSCRLTTDDVQALGEAFEMIPELEELNLSWNSKVGGNLPLILQKFQKGSKIQMIELVDCSLTSEDGTFLGQLLPMLQSLEVLDLSINRDIVGSLNSIAQGLKSTSNLKVLKLHSCGLSQKSVKILDAAFRYLGELRKLDLSCNKDLGGGFEDSPAQLVMLKHLQVLDLHQCSLTADDVMSLTQVIPLLSNLQELDLSANKKMGSSSENLLSRLRFLPALKSLVINNCALESETFTALAEASVHLSALEVFNLSWNKCVGGNLKLLLETLKLSMSLQVLRLSSCSLVTEDVALLASVIQTGHLAKLQKLDLSYNDSICDAGWTMFCQNVRFLKELIELDISLRPSNFRDCGQWFRHLLYAVTKLPQITEIGMKRWILPASQEEELECFDQDKKRSIHFDHGGFQ

SEQ ID NO: 13379 - protein, 419 aa, Homo sapiens
MGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALSVVSNNIEGEGLVALSQSMKTNLTFSHIYIWGNKFDEATCIAYSDLIQMGCLKPDNTDVEPFVVDGRVYLAEVSNGLKKHYYWTSTYGESYDHSSNAGFALVPVGQQP

SEQ ID NO: 13380 - protein, 464 aa, Homo sapiens
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALSVVSNNIEGEGLVALSQSMKTNLTFSHIYIWGNKFDEATCIAYSDLIQMGCLKPDNTDVEPFVVDGRVYLAEVSNGLKKHYYWTSTYGESYDHSSNAGFALVPVGQQP

SEQ ID NO: 13381 - protein, 432 aa, Homo sapiens
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALSVVSNNIEGEGLVALSQSMKTNLTFSHIYIWGNKFDEATCIAYSDLIQMGCLKPDNTDVEPFVVDGRVYLAEVSNGLKKHYYWTSTYGESYDHSSNAGFALVPVGQQP

SEQ ID NO: 13382 - protein, 326 aa, Homo sapiens
MTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGKFEAKTGQSAGGKPHFVRKNSTVGGRCCHLNCEWATVTYL

SEQ ID NO: 13383 - protein, 754 aa, Homo sapiens
MAEQWELDEEGIRRLGALTLEQPELVESLSLQGSYAGKIHSIGDAFRNFKNLRSLDLSRNLITSLKGIQYLCSLQDLNLYYNNIPSLVEVSRLQPLPFLKELDLRLNPVVRKDTDYRLFAVYTLQTLEKLDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 13384 - protein, 529 aa, Homo sapiens
MLRPRFLPPDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 13385 - protein, 226 aa, Homo sapiens
MEGQYPCQPESKAWFPRCYRQRVTWVVCTVWLETTVPPSLPEPPMWPLSSDSSWSLWISTGMAPAPSSSTRSFSESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 13386 - protein, 633 aa, Homo sapiens
MLRPRFLPPDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 13387 - protein, 1700 aa, Homo sapiens
MSSAQCPALVCVMSRLRFWGPWPLLMWQLLWLLVKEAQPLEWVKDPLQLTSNPLGPPDSWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETRHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIENNNTKHTTARNAFEENDFMENTNMPEGTISENTNYNHPHEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDMYKPLSATRINNHAWKLHKKSSNEDKILNRDPGDSEAPTEEEESEALP

SEQ ID NO: 13388 - protein, 1700 aa, Homo sapiens; identical to SEQ ID NO: 13387

SEQ ID NO: 13389 - protein, 335 aa, Homo sapiens
MTENVVCTGAVNAVKEVWEKRIKKLNEDLKREKEFQHKLVRIWEERVSLTKLREKVTREDGRVILKIEKEEWKTLPSSLLKLNQLQEWQLHRTGLLKIPEFIGRFQNLIVLDLSRNTISEIPPGIGLLTRLQELILSYNKIKTVPKELSNCASLEKLELAVNRDICDLPQELSNLLKLTHLDLSMNDFTTIPLAVLNMPALEWLDMGSNKLEQLPDTIERMQNLHTLWLQRNEITCLPQTISNMKNLGTLVLSNNKLQDIPVCMEEMANLRFVNFRDNPLKLKVSLPPSEGTDEEEERELFGLQFMHTYIQESRRRADHQVNGSTTLPISINTDG

SEQ ID NO: 13390 - protein, 339 aa, Homo sapiens
MTENVVCTGAVNAVKEVWEKRIKKLNEDLKREKEFQHKLVRIWEERVSLTKLREKVTREDGRVILKIEKEEWKTLPSSLLKLNQLQEWQLHRTGLLKIPEFIGRFQNLIVLDLSRNTISEIPPGIGLLTRLQELILSYNKIKTVPKELSNCASLEKLELAVNRDICDLPQELSNLLKLTHLDLSMNDFTTIPLAVLNMPALEWLDMGSNKLEQLPDTIERMQNLHTLWLQRNEITCLPQTISNMKNLGTLVLSNNKLQDIPVCMEEMANLRFVNFRDNPLKLKVSLPPSEGTDEEEERELFGLQFMHTYIQESRRRAALQFCVCHGQILTIYTCMALEI

SEQ ID NO: 13391 - protein, 335 aa, Homo sapiens; identical to SEQ ID NO: 13389

SEQ ID NO: 13392 - protein, 339 aa, Homo sapiens; identical to SEQ ID NO: 13390

SEQ ID NO: 13393 - protein, 602 aa, Homo sapiens
MSRLKRIAGQDLRAGFKAGGRDCGTSVPQGLLKAARKSGQLNLSGRNLSEVPQCVWRINVDIPEEANQNLSFGATERWWEQTDLTKLIISNNKLQSLTDDLRLLPALTVLDIHDNQLTSLPSAIRELENLQKLNVSHNKLKILPEEITNLRNLKCLYLQHNELTCISEGFEQLSNLEDLDLSNNHLTTVPASFSSLSSLVRLNLSSNELKSLPAEINRMKRLKHLDCNSNLLETIPPELAGMESLELLYLRRNKLRFLPEFPSCSLLKELHVGENQIEMLEAEHLKHLNSILVLDLRDNKLKSVPDEIILLRSLERLDLSNNDISSLPYSLGNLHLKFLALEGNPLRTIRREIISKGTQEVLKYLRSKIKDDGPSQSESATETAMTLPSESRVNIHAIITLKILDYSDKQATLIPDEVFDAVKSNIVTSINFSKNQLCEIPKRMVELKEMVSDVDLSFNKLSFISLELCVLQKLTFLDLRNNFLNSLPEEMESLVRLQTINLSFNRFKMLPEVLYRIFTLETILISNNQVGSVDPQKMKMMENLTTLDLQNNDLLQIPPELGNCVNLRTLLLDGNPFRVPRAAILMKGTAAILEYLRDRIPT

SEQ ID NO: 13394 - protein, 216 aa, Homo sapiens
MLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPQPPPMRLLAPSGHLLLQQPPPLPLLLHPHTNGHQLAQPHSLSP

SEQ ID NO: 13395 - protein, 812 aa, Homo sapiens
MAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 13396 - protein, 695 aa, Homo sapiens
MEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRHSWGMLACWPWQMFSQRIHPPLSVSWTSVPTASSQMGFWSSPSGWSAGAVEPLVTCASSKTGWTRMQSQPGKPSGGSGLPAMWLATHGTHPRPSQIMLAPCDGARTSQSHARYHQLAGAEAWAAQNPNHQFYLSLSVTFFLFFPSSLALRSWRP

SEQ ID NO: 13397 - protein, 428 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLDLSCNPEITDAGIGYLFSFRKLNCLDISGTGLKDIKTVKHKLQTHIGLVHSKVPLKEFDHSNCKTEGWADQIVLQWERVTAEAVKPRETSEPRAAAQRFYGKRSRAEAPLKCPLADTHMNSSEKLQFYKEKAPDCHGPVLKHEAISSQESKKSKKRPFEESETEQNNSSQPSKQKYVCLAVEDWDLLNSY

SEQ ID NO: 13398 - protein, 192 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELL

SEQ ID NO: 13399 - protein, 428 aa, Homo sapiens; identical to SEQ ID NO: 13397

SEQ ID NO: 13400 - protein, 239 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLD

SEQ ID NO: 13401 - protein, 527 aa, Homo sapiens
MECLCAHPPAGLQHLGLGHNKLLGPLESLYVTANHWGRVRLGLGDAVLTAAACVFLLFSEPRSICFLVCGSRLLAPCSPGFLTPRRSCSPSRPNLVSLDLGFNDLTDLQSMVTSLRTLRHLRLLVLQGNPLALVPYYRGLTIDSLAQLCVLDDITVSPNEKHLFRGLSLNGDLLAQEAQFVVTIGNIRGVLDTSVLDPEPRPEGPFITYNYYVTYDFVKDEEGEMNESAGVLAEIVKPSPSLELLVEESPEEVVEDVIEDIVEEVTEEVEGSLESEVEESGESELSVISGPSTILQMPRASAEELAKLRLRIDPRLCPSPGTVLFSTAHKPWAEVIPCSYEMQHSLRDLVPLKAFLLAGTTVTIVEEKILSWPVVLPAVDSPLSAKKGKGEKDKKGKEKDRTGKGEKEPAKEWKVLKKKKEPPKELRQDPPILQVLGRGLVILEPLLAGEPLVSTVCNFGVVRTLTSDRLTLARDSKKIKKVAKKEKPKAVIPIYEGDYHPEPLTVEVQIQLNQCRSAEEALRMFAV

SEQ ID NO: 13402 - protein, 656 aa, Homo sapiens
MEASYESESESESEAGPGTQRPGTGTVSAAVREHLRKLCLREFPCGAGSWNKSRFLPQTWRTWRELVPREEDVVSPGEETVEALLGLVRSRHSPWALLNNSNAEDSFLRELAIRNPLTITDTFFYSYFRSLRVIDKKVTLVDKDLLKFLKLEELVLSANRIKEVDATNLPPTLKVLELYGNEISSMECLCAHPPAGLQHLGLGHNKLLGPLESLYVTANHWPNLVSLDLGFNDLTDLQSMVTSLRTLRHLRLLVLQGNPLALVPYYRGLTIDSLAQLCVLDDITVSPNEKHLFRGLSLNGDLLAQEAQFVVTIGNIRGVLDTSVLDPEPRPEGPFITYNYYVTYDFVKDEEGEMNESAGVLAEIVKPSPSLELLVEESPEEVVEDVIEDIVEEVTEEVEGSLESEVEESGESELSVISGPSTILQMPRASAEELAKLRLRIDPRLCPSPGTVLFSTAHKPWAEVIPCSYEMQHSLRDLVPLKAFLLAGTTVTIVEEKILSWPVVLPAVDSPLSAKKGKGEKDKKGKEKDRTGKGEKEPAKEWKVLKKKKEPPKELRQDPPILQVLGRGLVILEPLLAGEPLVSTVCNFGVVRTLTSDRLTLARDSKKIKKVAKKEKPKAVIPIYEGDYHPEPLTVEVQIQLNQCRSAEEALRMFAV

SEQ ID NO: 13403 - protein, 471 aa, Homo sapiens
MECLCAHPPAGLQHLGLGHNKLLGPLESLYVTANHWPNLVSLDLGFNDLTDLQSMVTSLRTLRHLRLLVLQGNPLALVPYYRGLTIDSLAQLCVLDDITVSPNEKHLFRGLSLNGDLLAQEAQFVVTIGNIRGVLDTSVLDPEPRPEGPFITYNYYVTYDFVKDEEGEMNESAGVLAEIVKPSPSLELLVEESPEEVVEDVIEDIVEEVTEEVEGSLESEVEESGESELSVISGPSTILQMPRASAEELAKLRLRIDPRLCPSPGTVLFSTAHKPWAEVIPCSYEMQHSLRDLVPLKAFLLAGTTVTIVEEKILSWPVVLPAVDSPLSAKKGKGEKDKKGKEKDRTGKGEKEPAKEWKVLKKKKEPPKELRQDPPILQVLGRGLVILEPLLAGEPLVSTVCNFGVVRTLTSDRLTLARDSKKIKKVAKKEKPKAVIPIYEGDYHPEPLTVEVQIQLNQCRSAEEALRMFAV

SEQ ID NO: 13404 - protein, 321 aa, Homo sapiens
MSGGKSAQGPEEGGVCITEALITKRNLTFPEDGELSEKMFHTLDELQTVRLDREGITTIRNLEGLQNLHSLYLQGNKIQQIENLACIPSLRFLSLAGNQIRQVENLLDLPCLQFLDLSENLIETLKLDEFPQSLLILNLSGNSCTNQDGYRELVTEALPLLLDLDGQPVVERWISDEEDEASSDEEFPELSGPFCSERGFLKELEQELSRHREHRQQTALTEHLLRMEMQPTLTDLPLLPGVPMAGDSSPSATPAQGEETVPEAVSSPQASSPTKKPCSLIPRGHQSSFWGRKGARAATAPKASVAEAPSTTKTTAKRSKK

SEQ ID NO: 13405 - protein, 583 aa, Homo sapiens
MAAAAVSESWPELELAERERRRELLLTGPGLEERVRAAGGQLPPRLFTLPLLHYLEVSGCGSLRAPGPGLAQGLPQLHSLVLRRNALGPGLSPELGPLPALRVLDLSGNALEALPPGQGLGPAEPPGLPQLQSLNLSGNRLRELPADLARCAPRLQSLNLTGNCLDSFPAELFRPGALPLLSELAAADNCLRELSPDIAHLASLKTLDLSNNQLSEIPAELADCPKLKEINFRGNKLRDKRLEKMVSGCQTRSILEYLRVGGRGGGKGKGRAEGSEKEESRRKRRERKQRREGGDGEEQDVGDAGRLLLRVLHVSENPVPLTVRVSPEVRDVRPYIVGAVVRGMDLQPGNALKRFLTSQTKLHEDLCEKRTAATLATHELRAVKGPLLYCARPPQDLKIVPLGRKEAKAKELVRQLQLEAEEQRKQKKRQSVSGLHRYLHLLDGNENYPCLVDADGDVISFPPITNSEKTKVKKTTSDLFLEVTSATSLQICKDVMDALILKMAEMKKYTLENKEEGSLSDTEADAVSGQLPDPTTNPSAGKDGPSLLVVEQVRVVDLEGSLKVVYPSKADLATAPPHVTVVR

SEQ ID NO: 13406 - protein, 504 aa, Homo sapiens
MLRLVAACPESCVVCTKDVTLCHQLTYIVAAPMTTRVLIITDGYLSSIESTNLSLLFNLALLSLSRNGIEDVQEDALHGLTMLRTLLLEHNQISSSSLTDHTFSKLHSLQVLVLSNNALRTLRGSWFRNTSGLTRLQLDGNQITNLTDSSFGGTNLHSLRYLDLSNNFISYIGKDAFRPLPQLQEVDLSRNRLAHMPDVFTPLKQLILLSLDKNQWSCTCDLHPLARFLRNYIKSSAHTLRNAKDLNCQPSTAAVAAAQSVLRLSETNCDSKAPNFTLVLKDRSPLLPGPDVALLTVLGFAGAVGLTCLGLVVFNWKLHQGKANEHTSENLCCRTFDEPLCAHEARNYHTKGYCNCHLTQENEIKVMSTVGSRKEMPLLQENSHQATSASESATLDGSFRNLKKKDRGVGSTLFCQDGRLLHSECSEPPGNMRAFNEAGLLTTYNPRKVQKLWNLEPGEVQPQTLQHHIIRTEDISSDIFRRRYATPASALAGESLEKRLTNES

SEQ ID NO: 13407 - protein, 510 aa, Homo sapiens
MLRLVAACPESCVVCTKDVTLCHQLTYIVAAPMTTRVLIITDGYLSSIESTNLSLLFNLALLSLSRNGIEDVQEDALHGLTMLRTLLLEHNQISSSSLTDHTFSKLHSLQVLVLSNNALRTLRGSWFRNTSGLTRLQLDGNQITNLTDSSFGGTNLHSLRYLDLSNNFISYIGKDAFRPLPQLQEVDLSRNRLAHMPDVFTPLKQLILLSLDKNQWSCTCDLHPLARFLRNYIKSSAHTLRNAKDLNCQPSTAAVAAAQSVLRLSETNCDSKAPNFTLVLKDRSPLLPGPDVALLTVLGFAGAVGLTCLGLVVFNWKLHQGKANEHTSENLCCRTFDEPLCAHEARNYHTKGYCNCHLTQENEIKVMSTVGSRKEMPLLQENSHQATSASESATLDGSFRNLKKKDRGVGSTLFCQDGRLLHSECSEPPGNMRAFNEAGLLTTYNPRKVQKLWNLEPGEVQPQTLQHHIIRTEDISSDIFRRRYATPASALAGESLEKRLTNESWQPPIE

SEQ ID NO: 13408 - protein, 542 aa, Homo sapiens
MDLGWDRSRGPRRSTSSVRVRELSWQGLHNPCPQSKGPGSQRDRLGEQLVEEYLSPARLQALARVDDLRLVRTLEMCVDTREGSLGNFGVHLPNLDQLKLNGSHLGSLRDLGTSLGHLQVLWLARCGLADLDGIASLPALKELYASYNNISDLSPLCLLEQLEVLDLEGNSVEDLGQVRYLQLCPRLAMLTLEGNLVCLQPAPGPTNKVPRGYNYRAEVRKLIPQLQVLDEVPAAHTGPPAPPRLSQDWLAVKEAIKKGNGLPPLDCPRGAPIRRLDPELSLPETQSRASRPWPFSLLVRGGPLPEGLLSEDLAPEDNTSSLTHGAGQVLCGNPTKGLRERRHQCQAREPPEQLPQHRPGDPAASTSTPEPDPADSSDFLALAGLRAWREHGVRPLPYRHPESQQEGAVAPWGPRRVPEEQVHQAEPKTPSSPPSLASEPSGTSSQHLVPSPPKHPRPRDSGSSSPRWSTDLQSRGRRLRVLGSWGPGLGDGVAAVPVLRALEVASRLSPRAQGCPGPKPAPDAAARPPRAAELSHPSPVPT

SEQ ID NO: 13409 - protein, 239 aa, Homo sapiens
MGNSALRAHVETAQKTGVFQLKDRGLTEFPADLQKLTSNLRTIDLSNNKIESLPPLLIGKFTLLKSLSLNNNKLTVLPDEICNLKKLETLSLNNNHLRELPSTFGQLSALKTLSLSGNQLGALPPQLCSLRHLDVMDLSKNQIRSIPDSVGELQVIELNLNQNQISQISVKISCCPRLKILRLEENCLELSMLPQSILSDSQICLLAVEGNLFEIKKLRELEGYDKYMERFTATKKKFA

SEQ ID NO: 13410 - protein, 239 aa, Homo sapiens; identical to SEQ ID NO: 13409

SEQ ID NO: 13411 - protein, 371 aa, Homo sapiens
MEEAGAAVVTAGEAELNWSRLSVSTETLESELEARGEERRGAREALLRLLLPHNRLVSLPRALGSGFPHLQLLDVSGNALTALGPELLALRGLRTLLAKNNRLGGPSALPKGLAQSPLCRSLQVLNLSGNCFQEVPASLLELRALQTLSLGGNQLQSIPAEIENLQSLECLYLGGNFIKEIPPELGNLPSLNYLVLCDNKIQSIPPQLSQLHSLRSLSLHNNLLTYLPREILNLIHLEELSLRGNPLVVRFVRDLTYDPPTLLELAARTIKIRNISYTPYDLPGNLLRYLGSASNCPNPKCGGVYFDCCVRQIKFVDFCGKYRLPLMHYLCSPECSSPCSSASHSSTSQSESDSEDEASVAARRMQKVLLG

SEQ ID NO: 13412 - protein, 259 aa, Homo sapiens
MDPPAEKPGEAGGLQITPQLLKSRTGEFSLESILLLKLRGLGLADLGCLGECLGLEWLDLSGNALTHLGPLASLRQLAVLNVSNNRLTGLEPLATCENLQSLNAAGNLLATPGQLQCLAGLPCLEYLRLRDPLARLSNPLCANPSYWAAVRELLPGLKVIDGERVIGRGSEFYQLCRDLDSSLRPSSSPGPRATEAQPWVEPGYWESWPSRSSSILEEACRQFQDTLQECWDLDRQASDSLAQAEQVLSSAGPTSSFVF

SEQ ID NO: 13413 - protein, 259 aa, Homo sapiens; identical to SEQ ID NO: 13412

SEQ ID NO: 13414 - protein, 259 aa, Homo sapiens; identical to SEQ ID NO: 13412

SEQ ID NO: 13415 - protein, 581 aa, Homo sapiens
MQKPPLLLRRPLPPKFTKLSLHEKKTHTAKTGKIESLHVAFTEDETTSIKMDRTRFPDVLRNQSLTPINIQNIFLDHCVQERVTAISSPQKSTKHVREQIPDTATGSIFFPHCNSASTRIFGKQTNKMESSRKFKTMKDVYTEKRLENILILSSKFSKPKSTPGSVIAQKLEKMHPKHQPLPESPGYTYQHISRDLSATVPSPPPMTVSMKPEGQWPEHFKSTATLTLRVTEFPGFVSLPTPVLPRKPHRQSVIETLVTENGNIESVPKQIPPRPPEGLTKTEKIESEIHVVRGEGFKTVAATRYETITAMTNLAIVNCQVYGRNALNLKGFFILNCPDLTPLAFQLIYLNLSFNDLHYFPTEILCLKNLQILKLRNNPIKEIPSEIQQLEFLRIFTIAFNLITVLPIGLFSLSYLEELDVSYNELTFIPNEIQKLRSLEKLTVDGNELSFFPHGILKLNLTKIQFENNFTHPCFWRDNYLNNPQQLTQIISLFIVQNKLHKFYDKIPVEVQKLLKWWGAQFLTELAPLSIYSSRKAITEGYIAVELPKFEESKNITEGLLTQKRYEEVMVKCINATTVTS

SEQ ID NO: 13416 - protein, 191 aa, Homo sapiens
MTERLLIKALSGGKNTKIITLNGKKMTKMPSALGKLPGLKTLVLQNNLIPKVCPELCNLTQFQDLKLREFYCEGNPLFLQQPVISTQQENVWSLQEITSRFVMNQLAENNPFLMDDIERYPQVRSMISQGKTCAICGQYFITVWLECVRFVPPPKDWKISKNLKLVPLQVLICSYKCFTQRDPNLFGIAQV

SEQ ID NO: 13417 - protein, 50 aa, Homo sapiens
MTERLLIKALSGGKNTKIITLNGKKMTKMPSALGKLPGLKTLVLQNNLIP

SEQ ID NO: 13418 - protein, 347 aa, Homo sapiens
MTERLLIKALSGGKNTKIITLNGKKMTKMPSALGKLPGLKTLVLQNNLIPKVCPELCNLTQLTTLNLGNNLLEEVPEEMKYLTSLKNLHLSGNRICRFAPGACDGLQNLILLNLNNNHLTQLPQEVSRLKSLTYMSINYNQLASIPRELCFLENLVELQLNYNQLICIPEEIKFLKKLQKLLLARNNIGVLPEELCDLKKLRILDIAGNIIQIFPSGFQDLKLREFYCEGNPLFLQQPVISTQQENVWSLQEITSRFVMNQLAENNPFLMDDIERYPQVRSMISQGKTCAICGQYFITVWLECVRFVPPPKDWKISKNLKLVPLQVLICSYKCFTQRDPNLFGIAQV

SEQ ID NO: 13419 - protein, 559 aa, Homo sapiens
MSSEQSAPGASPRAPRPGTQKSSGAVTKKGERAAKEKPATVLPPVGEEEPKSPEEYQCSGVLETDFAELCTRWGYTDFPKVVNRPRPHPPFVPSASLSEKATLDDPRLSGSCSLNSLESKYVFFRPTIQVELEQEDSKSVKEIYIRGWKVEERILGVFSKCLPPLTQLQAINLWKVGLTDKTLTTFIELLPLCSSTLRKVSLEGNPLPEQSYHKLMALDSTIAHLSLRNNNIDDRGAQLLGQALSTLHSCNRTLVSLNLGFNHIGDEGAGYIADGLRLNRSLLWLSLAHNRIQDKGALKLAEVLRAFELTHTEVVERRRLLLEKGTQERSRSPSSSRHGDSKTDREKSQMVGISNSALVDKTDKTQTMKTPKGLGKKKEKSWELAKKEEKLGSGQSPTQGTPKKEDATKAGKGKVTIPEQKPSRAKGIKIGSREKRSILLESELVVEATEVVNPLLEPVEHRDGKVFMPGNKVLLHLNLIRNRITEVGLEGFLATVQYQMQFSKAKSASKGPVGLLWLSLAKNCFAPQCPAYAIIQELMLPRDPIKAKLREDEAMAFFP

SEQ ID NO: 13420 - protein, 287 aa, Homo sapiens
MSWDPNPVPRTLRCWRLRRASETALQSSRRAVEDQLKICGHRRDADVFELFLSKKELTEVIDLSRFKKLKYLWLHHNKLHGITFLTRNYCLTELYLNNNAIFEIEGLHYLPSLHILLLHHNELTNIDATVKELKGMLNLKILSLYQNPLCQYNLYRLYIIYHLPGVELLDRNQVTEKERRSMITIFNHKKAHIVQSIAFGGKVDASWDPKSPFKQKPAQRVPSDFAFANNVDKTVLDDPEDAVFVRSMKRSVMTLTSMNWDTVPTREERYLEEEGTETAQMLTVTLR

SEQ ID NO: 13421 - protein, 316 aa, Homo sapiens
MLPSSIQISGEPLSGAEVRDICRGLRDNAVRLLSLRGCRLCDRDFGRICRALAGATSLAQLNLNLGVVSSPSRIKQLAEALRTNRSIQSLFLHGSPLTDAGLALLNPALALHPALVALDLGDCMLGDEAINLICGLLPPDGAKSGLKELTLSANPGITPKGWSRLAIAVAHSSQVRVLNLDYNPLGDHVAGMLAVAVASSRTLEVLDLEGTGLTNQSAQTLLDMVENYPTALRSLVLAENSISPELQQQICDLLSEGEEEEEVAGGAGDTQEWERGREPAAHQRGSSSWMCPSDPSSQMVLMTSGLGDSLLAETEM

SEQ ID NO: 13422 - protein, 414 aa, Homo sapiens
MKLHCEVEVISRHLPALGLRNRGKGVRAVLSLCQQTSRSQPPVRAFLLISTLKDKRGTRYELRENIEQFFTKFVDEGKATVRLKEPPVDICLSKAISSSLKGFLSAMRLAHRGCNVDTPVSTLTPVKTSEFENFKTKMVITSKKDYPLSKNFPYSLEHLQTSYCGLVRVDMRMLCLKSLRKLDLSHNHIKKLPATIGDLIHLQELNLNDNHLESFSVALCHSTLQKSLRSLDLSKNKIKALPVQFCQLQELKNLKLDDNELIQFPCKIGQLINLRFLSAARNKLPFLPSEFRNLSLEYLDLFGNTFEQPKVLPVIKLQAPLTLLESSARTILHNRIPYGSHIIPFHLCQDLDTAKICVCGRFCLNSFIQGTTTMNLHSVAHTVVLVDNLGGTEAPIISYFCSLGCYVNSSDMLK

SEQ ID NO: 13423 - protein, 146 aa, Homo sapiens
MKLHCEVEVISRHLPALGLRNRGKGVRAVLSLCQQTSRSQPPVRAFLLISTLKDKRGTRYELRENIEQFFTKFVDEGKATVRLKEPPVDICLSKDSIWLSYHSIPSLPRFGYRKNLCLWKILSELFHSRNYYHESAFCCPHCGLSR

SEQ ID NO: 13424 - protein, 422 aa, Homo sapiens
MKLHCEVEVISRHLPALGLRNRGKGVRAVLSLCQQTSRSQPPVRAFLLISTLKDKRGTRYELRENIEQFFTKFVDEGKATVRLKEPPVDICLSKMESHSVTQVGVQWEELGSLQPTGHFQQFKRFPFSYETGHRGCNVDTPVSTLTPVKTSEFENFKTKMVITSKKDYPLSKNFPYSLEHLQTSYCGLVRVDMRMLCLKSLRKLDLSHNHIKKLPATIGDLIHLQELNLNDNHLESFSVALCHSTLQKSLRSLDLSKNKIKALPVQFCQLQELKNLKLDDNELIQFPCKIGQLINLRFLSAARNKLPFLPSEFRNLSLEYLDLFGNTFEQPKVLPVIKLQAPLTLLESSARTILHNRTIYPKEINVNMWETLPGRISLGCMYDFAASNWSKGRFLYTCWRGGMCIVTHLDDSKTFIKTNFSF

SEQ ID NO: 13425 - protein, 168 aa, Homo sapiens
MHPSLATMGKLASKLQLDLSVVKIWFKNQRAKWKRQQRQQMQTRPSLGPANQTTSVKKEETPSAITTANIRPVSPGISDANDHDLREPSGIKNPGGASASARVSSWDSQSYDIEQICLGASNPPWASTLFEIDEFVKIYDLPGEDDTSSLNQYLFPVCLEYDQLQSSV

SEQ ID NO: 13426 - protein, 182 aa, Homo sapiens
  MOD_RES (1)..(1): Any amino acid
XAHGFQPHASVEPACQAGTWNLKQLSQEGPRRYRRPRTRFLSKQLTALRELLEKTMHPSLATMGKLASKLQLDLSVVKIWFKNQRAKWKRQQRQQMQTRPSLGPANQTTSVKKEETPSAITTANIRPVSPGISDANDHDLREPSGIKNPGGASASARVSSWDSQSYDIEQICLGASNPPWAS

SEQ ID NO: 13427 - protein, 190 aa, Homo sapiens
MASRGKTETSKLKQNLEEQLDRLMQQLQDLEECREELDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLGSGDKILALASFEVEKTKK

SEQ ID NO: 13428 - protein, 190 aa, Homo sapiens; identical to SEQ ID NO: 13427

SEQ ID NO: 13429 - protein, 190 aa, Homo sapiens; identical to SEQ ID NO: 13427

SEQ ID NO: 13430 - protein, 211 aa, Homo sapiens
MNNFIFLKFMTLGTSRTGEIKMASRGKTETSKLKQNLEEQLDRLMQQLQDLEECREELDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLGSGDKILALASFEVEKTKK

SEQ ID NO: 13431 - protein, 239 aa, Homo sapiens
MVQPQTSKAESPALAASPNAQMDDVIDTLTSLRLTNSALRREASTLRAEKANLTNMLESVMAELTLLRTRARIPGALQITPPISSITSNGTRPMTTPPTSLPEPFSGDPGRLAGFLMQMDRFMIFQASRFPGEAERVAFLVSRLTGEAEKWAIPHMQPDSPLRNNYQGFLAELRRTYKSPLRHARRAQIRKTSASNRAVRERQMLCRQLASAGTGPCPVHPASNGTSPAPALPARARNL

SEQ ID NO: 13432 - protein, 692 aa, Homo sapiens
MDHHIPMHALPEEIQKMLPEEKVCKYCGVSYLILHEFKAMEEKVKAMEKEMKFYQGSVDREKRLQEKLHSLSQELEQYKIDNKSKTERIYDVGMQLKSQQNEFQKVKKQLSHLQDELKIKYRQSYIFSQRLSEYKYFWNKTLSLLTFTKRELTSIKNEVYDNYQNWTSLKGAVFLQIKSISETALTEIDILNKSLTVSQRNKVCLEKEMKNLKLLSDAAILRSQQIRTSRQQEVNLQTRCYDLQKEVLDLQCLVEALGLKLQKAVTEMDNYKEMLMNKSNEADDCQRELKKLKFESIISESQHTMLLKEKEDSLMTCQQIYKALQEELTVKEKQEEDIKRRINLAENELEITKTLLNQTREEVLTLKNERELMLISHQKSIEQLQETLRQKLLSDDNWKEKIEAELAKERAQHLVEFEEQALLFKEETKLQLDIEKEKHQDVIQKYKKEQEELQMKISDLITGATRDLRQEVTTLKEKLHKSHIRYTEESNSKEKEIENLKNLVAEFESRLKKEIDSNDSVSENLRKEMEQKSDELKRVMLAQTQLIEQFNQSQEENTFLQETVRRECEERFELTEALSQAREQLLELSKLRGSLPFSPCSLSKGSLTSPAAAVSNHGERSLARLNSEKGIQIPNLRGVSKPTTFPTSDKPKRVRSGVPILPQPHPPRGGASSANETRQRLAAILRRRRSQQ

SEQ ID NO: 13433 - protein, 388 aa, Homo sapiens [sequence omitted]

SEQ ID NO: 13434 - protein, 550 aa, Homo sapiens
MASVFHYFLLVLVFLDTHAAQPFCLPGCTCSEESFGRTLQCTSVSLGKIPGNLSEEFKQVRIENSPLFEMPQGSFINMSTLEYLWLNFNNISVIHLGALEHLPELRELRLEGNKLCSVPWTAFRATPLLRVLDLKRNKIDALPELALQFLVSLTYLDLSSNRLTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLHVTVVLCVVLLAVPVGAYAWAAQGPCSCSKWVLRGCLHRRKAPSCTPAAPQSKDGSFREHPAVCDDGEGHIDTEGDKEKGGTEDNS

SEQ ID NO: 13435 - protein, 560 aa, Homo sapiens
MASVFHYFLLVLVFLDTHAAQPFCLPGCTCSEESFGRTLQCTSVSLGKIPGNLSEEFKQVRIENSPLFEMPQGSFINMSTLEYLWLNFNNISVIHLGALEHLPELRELRLEGNKLCSVPWTAFRATPLLRVLDLKRNKIDALPELALQFLVSLTYLDLSSNRLTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDGLLGGKHLTPVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLHVTVVLCVVLLAVPVGAYAWAAQGPCSCSKWVLRGCLHRRKAPSCTPAAPQSKDGSFREHPAVCDDGEGHIDTEGDKEKGGTEDNS

SEQ ID NO: 13436 - protein, 391 aa, Homo sapiens
MRGSCERSGEDEEQKEEAMVACGRLSGVPEAEQGPEANWDSDLETEGTDGLGELVRDTLYLRSCRAHSVVPISCFLRQGSAQELNLRHRGLGPQGARALASSLSSNPYVKRLDLRDNGLCGAGAEALAGALSKSSSIHDVDLSENQLGVAGAQALCAALTVNQAMRKMQLSGNGLEEQAAQHLAELLLAHTDLKSLDLSYNQLNDQAGETLGPALAENTGLTELNVSWNHLRGPGAVAFARGLEANIFLKVLDISYNGFGDPGASAVGEALKANNVLEELNMSNNRISAMGALSLGLGLRVNQTLRILVSRNPMRSEGCFGLLKSVQDNPASALELLDFSDIQVNAEFDGLASSVRGILPELCIKTGACRVEYKKELLPVFRSALPASVPK

SEQ ID NO: 13437 - protein, 161 aa, Homo sapiens
MRGSCERSGEDEEQKEEAMVACGRLSGVPEAEQGPEANWDSDLETEGTDGLGELVRDTLYLRSCRAHSVVPISCFLRQGSAQELNLRHRGLGPQGARALASSLSSNPYVKRLDLRDNGLCGAGAEALAGALSKSSSIHGRCWVWGRWAGVSSFSSGMCLHR

SEQ ID NO: 13438 - protein, 765 aa, Homo sapiens
MAASQGGGGNSGGGGCGGGGSSGGCGTAGGGGGGAGGGGGGGGGTLVVPIPVPTLFGQPFPNGPPWNPGSLQPQHTVRSLDRALEEAGSSGILSLSGRKLRDFPGSGYDLTDTTQADLSRNRFTEIPSDVWLFAPLETLNLYHNCIKTIPEAIKNLQMLTYLNISRNLLSTLPKYLFDLPLKVLVVSNNKLVSIPEEIGKLKDLMELDISCNEIQVLPQQMGKLHSLRELNIRRNNLHVLPDELGDLPLVKLDFSCNKVTEIPVCYRKLHHLQVIILDNNPLQVPPAQICLKGKVHIFKYLNIQACCRMDKKPDSLDLPSLSKRMPSQPLTDSMEDFYPNKNHGPDSGIGSDNGEKRLSTTEPSDDDTVSLHSQVSESNREQTSRNDSHIIGSKTDSQKDQEVYDFVDPNTEDVAVPEQGNAHIGSFVSFFKGKEKCSEKSRKNEELGDEKRLEKEQLLAEEEDDDLKEVTDLRKIAAQLLQQEQKNRILNHSTSVMRNKPKQTVECEKSVSADEVNSPLSPLTWQPLENQKDQIDEQPWPESHPIIWQSEERRRSKQIRKEYFKYKSMRKSSSGNENDEQDSDNANMSTQSPVSSEEYDRTDGFSHSPFGLKPRSAFSRSSRQEYGAADPGFTMRRKMEHLREEREQIRQLRNNLESRLKVILPDDIGAALMDGVVLCHLANHIRPRSVASIHVPSPAVPKLSMAKCRRNVENFLDACKKLGVSQERLCLPHHILEERGLVKVGVTVQALLELPTTKASQLSVA

SEQ ID NO: 13439 - protein, 244 aa, Homo sapiens
GLFSLPGTWRRVREEAVTVGESHPIIWQSEERRRSKQIRKEYFKYKSMRKSSSGNENDEQDSDNANMSTQSPVSSEEYDRTDGFSHSPFGLKPRSAFSRSSRQEYGAADPGFTMRRKMEHLREEREQIRQLRNNLESRLKVILPDDIGAALMDGVVLCHLANHIRPRSVASIHVPSPAVPKLSMAKCRRNVENFLDACKKLGVSQERLCLPHHILEERGLVKVGVTVQALLELPTTKASQLSVA

SEQ ID NO: 13440 - protein, 748 aa, Homo sapiens
MAASQGGGGNSGGGGCGGGGSSGGCGTAGGGGGGAGGGGGGGGGTLVVPIPVPTLFGQPFPNGPPWNPGSLQPQHTVRSLDRALEEAGSSGILSLSGRKLRDFPGSGYDLTDTTQADLSRNRFTEIPSDVWLFAPLETLNLYHNCIKTIPEAIKNLQMLTYLNISRNLLSTLPKYLFDLPLKVLVVSNNKLVSIPEEIGKLKDLMELDISCNEIQVLPQQMGKLHSLRELNIRRNNLHVLPDELGDLPLVKLDFSCNKVTEIPVCYRKLHHLQVIILDNNPLQVPPAQICLKGKVHIFKYLNIQACCRMDKKPDSLDLPSLSKRMPSQPLTDSMEDFYPNKNHGPDSGIGSDNGEKRLSTTEPSDDDTVSLHSQVSESNREQTSRNDSHIIGSKTDSQKDQEVYDFVDPNTEDVAVPEQGNAHIGSFVSFFKGKEKCSEKSRKNEELGDEKRLEKEQLLAEEEDDDLKEVTDLRKIAAQLLQQEQKNRILNHSTSVMRNKPKQTVECEKSVSADEVNSPLSPLTWQPLENQKDQIDEQPWPESHPIIWQSEERRRSKQIRKEYFKYKSMRKSSSGNENDEEYDRTDGFSHSPFGLKPRSAFSRSSRQEYGAADPGFTMRRKMEHLREEREQIRQLRNNLESRLKVILPDDIGAALMDGVVLCHLANHIRPRSVASIHVPSPAVPKLSMAKCRRNVENFLDACKKLGVSQERLCLPHHILEERGLVKVGVTVQALLELPTTKASQLSVA

SEQ ID NO: 13441 - protein, 748 aa, Homo sapiens; identical to SEQ ID NO: 13440

SEQ ID NO: 13442 - protein, 116 aa, Homo sapiens
MTQLKELDISNNAIREIPRNIGELRNLVSLHAYNNQISYLPPSLLSLNDLQQLNLSGNNLTALPSAIYNIFSLKEINFDDNPLLRPPVEICKGKQLYTIARYLQRADERDGLQLHS

SEQ ID NO: 13443 - protein, 860 aa, Homo sapiens
MSEKEGMSEVLEDTISQFRKESRSQSMKEPGFIKETSNLINEASDYLEGKSSNQIYETHPRQNTLESTSSSGRKSKRNEEQKKNLQFSETSTRTGTSQSLSSLTGRTAEYQALVNFLSHETVGEVSPQVSEENQKQLGLGADNFTVNLEAKGLQEFPKDILKIKYVKYLYLDKNQIKTFQGADSGDLLGLEILSLQENGLSSLPSEIQLLHNLRILNVSHNHISHIPKEISQLGNIRQLFFYNNYIENFPSDLECLGNLEILSLGKNKLRHIPDTLPSLKTLRVLNLEYNQLTTFPKALCFLPKLISLDLTGNLISSLPKEIRELKNLETLLMDHNKLTFLAVEIFQLLKIKELQLADNKLEVISHKIENFRELRILILDKNLLKNIPEKISCCAMLECLSLSDNKLTELPKYIHKLNNLRKLHVNRNNMVKITDCISHLNNICSLEFSGNIITDVPIEIKNCQKIIKIELSYNKIMYFPLGLCALDSLYYLSVNGNYISEIPVDISFSKQLLHLELSENKLLIFSEHFCSLINLKYLDLGKNQIKKIPASISNMISLHVLILCCNKFETFPRELCTLENLQVLDLSENQLQKISSDICNLKGIQKLNFSSNQFIHFPIELCQLQSLEQLNISQIKGRKLTRLPGELSNMTQLKELDISNNAIREIPRNIGELRNLVSLHAYNNQISYLPPSLLSLNDLQQLNLSGNNLTALPSAIYNIFSLKEINFDDNPLLRPPVEICKGKQLYTIARYLQRADERDEKILEKIFKIVANNITETNFEFLCQKLNLANSETDMPTKSTVSLSERAHQALVIWKTQSNKLSLTAAALRDQLIRALTMIGAYEIMDKITALNLFTRAIKF

SEQ ID NO: 13444 - protein, 59 aa, Homo sapiens
MSEKEGMSEVLEDTISQFRKESRSQSMKEPGFIKETSNLINEASDYLEGKSSNQIYETH

SEQ ID NO: 13445 - protein, 117 aa, Homo sapiens
MTQLKELDISNNAIREIPRNIGELRNLVSLHAYNNQISYLPPSLLSLNDLQQLNLSGNNLTALPSAIYNIFSLKEINFDDNPLLRPPVEICKGKQLYTIARYLQRADERDGRLKIHT

SEQ ID NO: 13446 - protein, 860 aa, Homo sapiens; identical to SEQ ID NO: 13443

SEQ ID NO: 13447 - protein, 825 aa, Homo sapiens
MATSERALLRTRAASLLRGLGRSRTGARSLQFRAEKERQPCWSFPMGQKTKGSSNIASSYLLQQLMHRYQELDSDGDEDQGEGEAGSEESSESEMLNLEEEFDGVLREEAVAKALHHLGRSGSGTEQVYLNLTLSGCNLIDVSILCGYVHLQKLDLSANKIEDLSCVSCMPYLLELNASQNNLTTFFNFKPPKNLKKADFSHNQISEICDLSAYHALTKLILDGNEIEEISGLEMCNNLIHLSLANNKITTINGLNKLPIKILCLSNNQIEMITGLEDLKALQNLDLSHNQISSLQGLENHDLLEVINLEDNKIAELREIEYIKNLPILRVLNLLENPIQEKSEYWFFVIFMLLRLTELDQKKIKVEEKVSAVNKYDPPPEVVAAQDHLTHVVNSVMQPQRIFDSTLPSLDAPYPMLILAGPEACGKRELAHRLCRQFSTYFRYGACHTTRPPYFGEGDRVDYHFISQDVFDEMVNMGKFILTFSYGNHKYGLNRDTVEGIARDGLASCIHMEIEGVRSLKYSYFEPRYILVVPMNKEKYEGYLRRKGLFSRAEIEFAVSRVDLYIKINQNFPGYFDEVINADDLDVAYQKLSQLIREYLGLTEEPAKSLATTADVKTSHLKPEAHPTKYISSNMGDFLHSTDRNYLIKFWAKLSAKKTPAERDSIHRQHEAARQALMGRIRPDHTLLFQRGPVPAPLTSGLHYYTTLEELWKSFDLCEDYFKPPFGPYPEKSGKDSLVSMKCSLFRFCPWSKELPFQPPEGSISSHLGSGASDSETEETRKALPIQSFSHEKESHQHRQHSVPVISRPGSNVKPTLPPIPQGRR

SEQ ID NO: 13448 - protein, 1310 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEK

SEQ ID NO: 13449 - protein, 164 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVE

SEQ ID NO: 13450 - protein, 1722 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKQEQDKMNDELYKEEKIWKEKFKQHEEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKIMAAVVIQSYWRGYLMRRQTHFSTRLHTAATEGLPNSSIKNQTILKKGKRENIVNIRKQREKAAILIQAVWKGFILRKKLTTALEAIKNEESDEEYREIDLEDFIFDEAALEEEWLALDSTRFPSQTLLLSNQLHWPKIPGNLKWDDTSFNLPSNPAQAWLCNDKENLSSSEHTQFNSRSENKTSSWTPESKTSRKSLLKSEKEKKISEEWGFKDISTAQQMLKRAQKMKSKKLKKKIDSTVRLALFKNNENKVSLPKSPKMVQPRRDGYFEGIEEDPIHKDTTANEKLERNREYTYQWLHTQVGVHETTSSRNMKCNHFLPELDPDVLNGGRVQLVARLVSREDTDLDLFSMTNGSALSVNREKKNQAHRHSAGSSSKLWFPSKLI

SEQ ID NO: 13451 - protein, 624 aa, Homo sapiens
MFHGTVTEELTSHEEWSHYNENIREGQKDFVFVKFNGLHLKSMENLQSCISLRVCIFSNNFITDIHPLQSCIKLIKLDLHGNQIKSLPNTKFWNGLKNLKLLYLHDNGFAKLKNICVLSACPTLIALTMFDCPVSLKKGYRHVLVNSIWPLKALDHHVISDEEIIQNWHLPERFKACNHRLFFNFCPALRKGTTYEEEINNIKHITSKINAILAHNSPVLIVQRWIRGFLVRKNLSPVFFHKKKQQEKIIRGYEAKWIYITKGYEDKLLKDLFFKPETNIKGKLAYWKHNIYYPVDLKNSSEHRKHVSSILCELKPKDLGMKSKTSRHLIQKGQESEDEIVDEKLDTSFRISVFKLPIYTSGSLKNNAVLREKKQHFFPAYPQPIYTTHPKPIIKKDIRLERSMKEFFAPQRAGMKLRTFSDIDKYYTEQKKQEYHKEKVRVVAMAQVARERVRVAVNEHLNQKKYATQKLIEENKETIQNSLRQVWQNRFNYLEKARERKALFLKEKSQKASERLLVQNLNNERTLLTRGLLKIDRLEKNEAVLKEKSLIVKQKLKAEKYRKNLLKEMKKVRSQEIYKRHCEEKFVMDMIAFEKACERLQDAKTKVAIVKTNLDFKVPNGLIK

SEQ ID NO: 13452 - protein, 299 aa, Homo sapiens
MFHGTVTEELTSHEEWSHYNENIREGQKDFVFVKFNGLHLKSMENLQSCISLRVCIFSNNFITDIHPLQSCIKLIKLDLHGNQIKSLPNTKFWNGLKNLKLLYLHDNGFAKLKNICVLSACPTLIALTMFDCPVSLKKGYRHVLVNSIWPLKALDHHVISDEEIIQNWHLPERFKACNHRLFFNFCPALRKGTTYEEEINNIKHITSKINAILAHNSPVLIVQRWIRGFLVRKNLSPVFFHKKKQQEKIIRGYEAKWIYITKGYEDKLLKDLFFKPETNIKGKLAYWKHDIKKLYSNHH

SEQ ID NO: 13453 - protein, 560 aa, Homo sapiens
MSKDIKSVEHSPKIHQRNDPQHVNDRTFFIDASNQSLTAIPLEIFTFTELEEVHLENNQIEEIPQEIQRLKNIRVLYLDKNNLRSLCPALGLLSSLESLDLSYNPIFSSSLVVVSFLHALRELRLYQTDLKEIPVVIFKNLHHLELLGLTGNHLKCLPKEIVNQTKLREIYLKRNQFEVFPQELCVLYTLEIIDLDENKIGAIPEEIGHLTGLQKFYMASNNLPVLPASLCQCSQLSVLDLSHNLLHSIPKSFAELRKMTEIGLSGNRLEKVPRLICRWTSLHLLYLGNTGLHRLRGSFRCLVNLRFLDLSQNHLHHCPLQICALKNLEVLGLDDNKIGQLPSELGSLSKLKILGLTGNEFLSFPEEVLSLASLEKLYIGQDQGFKLTYVPEHIRKLQSLKELYIENNHLEYLPVSLGSMPNLEVLDCRHNLLKQLPDAICQAQALKELRLEDNLLTHLPENLDSLVNLKVLTLMDNPMEEPPKEVCAEGNEAIWKYLKENRNRNIMATKIQAWWRGTMVQRGFGKFGELLKPQKKGKTSPKDKKGKKDVKGKPGKGKKK

SEQ ID NO: 13454 - protein, 178 aa, Homo sapiens
MEHKDDDDDDVSFAKWMSSFWGHSWREEDQRGLRERHRLQATSHRKTSLPCPLPVLPRIPSSDCHPRRHSHEDQEFRCRSHVRDYRKYSEDGSFKEPLESKGRSHSKIEKFSESFERQLCFRTKRSASLGPESRKERNERECLRMEIKSRKKVEEERSSRKEEHGEAHMAPLFEKGPE

SEQ ID NO: 13455 - protein, 481 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVENLIRMGMAGLVLVFLGILLFEAQHSQRNPQDAAGR

SEQ ID NO: 13456 - protein, 464 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSASHAKDYTVENLIRMGMAGLVLVFLGILLFEAQHSQRNPQDAAGR

SEQ ID NO: 13457 - protein, 632 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 13458 - protein, 193 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRRV

SEQ ID NO: 13459 - protein, 632 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 13460 - protein, 455 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGEGADPVLSELKGSAQAQAPRRALGWDGPREAVREA

SEQ ID NO: 13461 - protein, 631 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 13462 - protein, 264 aa, Homo sapiens
MNILPKKSWHVRNKDNVARVRRDEAQAREEEKERERRVLLAQQEARTEFLRKKARHQNSLPELEAAEAGAPGSGPVDLFRELLEEGKGVIRGNKEYEEEKRQEKERQEKALGILTYLGQSAAEAQTQPPWYQLPPGRGGPPPGPAPDEKIKSRLDPLREMQKHLGKKRQHGGDEGSRSRKEKEGSEKQRPKEPPSLDQLRAERLRREAAERSRAEALLARVQGRALQEGQPEEDETDDRRRRYNSQFNPQLARRPRQQDPHLTH

SEQ ID NO: 13463 - protein, 781 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLVSSCIKLSPCPLLPLPPVFLLIFFSPFPPSLSAFFPWFSTGKTVPPSLPPSSAM

SEQ ID NO: 13464 - protein, 800 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTFRPALPVSYLQAELAFEGEAACRAFLEPLGLAYTGPDNSSIDCRLSLAQLSAF

SEQ ID NO: 13465 - protein, 54 aa, Homo sapiens
MAANVGDQRSTDWSSQYSMVAGAGRENGMETPMHENPDRSGIDCRLSLAQLSAF

SEQ ID NO: 13466 - protein, 300 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERC

SEQ ID NO: 13467 - protein, 91 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQ

SEQ ID NO: 13468 - protein, 196 aa, Homo sapiens
MVCRLICVFHSTNAVSVFSLSLFRACTPVPDPAPWPIPCRGASGKKTGRPARARLRRGHPASPPTARCLTCFATDSCSQPLGASVFGVGELLRDCARPRPPTLKCQHHQHQILRRHTALRTRRPGRLVSSCIKLSPCPLLPLPPVFLLIFFSPFPPSLSAFFPWFSTGKTVPLPPCLHGSPAHVMLPSLFFVCVFI

SEQ ID NO: 13469 - protein, 501 aa, Homo sapiens
MGSRPPCGATSSARRACQFPAPMAAAREPELPQEAPATEPAPPPACRFFLEGRCRFGARCRQPHPGAPAPPGREAQPEAGAKKPPLRTAADVIQRIRWDPRLDPADFSVGYVDRFLGVREEPFSAFCWDQPLAALGPGVLAVPQHRVRFFRFHGRLVWDRASRTDLVFGSGSAAGRGPTILDAPNTEGAHGAEGAEWTLAGTGQEAQAAPKRGSTRPLCTGHQEPGVEEPGELEAAQERALGTAADLGTLAPRGRLAGVTEEALKPTAATRTTLLGGKEAQALGVPGGSAETTEAEWGPAAWPEDKRARLSVAAPCQPRPTHFVALMVTEPGLQAEVTKAQEYLVHVAPHCANFLVPSQNLHLTLALLRLAGAGEEAAAIGALRRALLAPGLNAPPRLSFRKLVLLGPHVLCAPPSPTLESMAQVLSQRLEAEGLSTLQSPGQLHPHLTVAKVPHGSQVHLPKLEFTLSQEVGCQPLQTLWLCRIGRTGGPFQPLAEIRLE

SEQ ID NO: 13470 - protein, 1083 aa, Homo sapiens
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPQFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 13471 - protein, 1466 aa, Homo sapiens
RKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFSFPETIEEEGSEVGSAGEDNPAGQMNPGWKPSDGGCELPDGSGKEHPSSDGAVVAPAPKSEEKDAAEIQKRKRLEQAGIKVMPAAQRFASQKQLSEEKEAIRDIVLRKENSFLTHQHGNDSEAEGEVVCRLPDLEKDDFAARRARMNQTKPMVPLNQLLYGPYPKKGAEKSDGSKQLSKGISKKRSLEYKRNQGHTEEVKLIVTCNMRAQESEPVEGGLRKVPDLHKDDLAQQRIQGSLAPHREPPSFITLSNITEADLETWERLKVSEKARDGDVQHICASEPSPEIKAETAIRDDFANRKARASKKASSPRQKFVHFGPVTELDQQKWKRLSIGKAGPREDEEEVICHGSKIQMDSVSPVSAATSSLKGHQIFNRQNDCRTMNCGRGDYCRRASWLAPVPESQEEWVCSLGECPRGTEEVTSKQLPQDGKEETESAPRDSERLSKAERSEDSSQPLVCPLASECEASGTEEKLEKMTAPAWSGSGLKGQRKLDDSRKDDMMARRTGMSLRHTGSNPNQFLPVPFAKQQDVEESSKGLPMKDQRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 13472 - protein, 890 aa, Homo sapiens
MDSERQVKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRSTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 13473 - protein, 902 aa, Homo sapiens
MDSERQVKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 13474 - protein, 1467 aa, Homo sapiens
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFSFPETIEEEGSEVGSAGEDNPAGQMNPGWKPSDGGCELPDGSGKEHPSSDGAVVAPAPKSEEKDAAEIQKRKRLEQAGIKVMPAAQRFASQKQLSEEKEAIRDIVLRKENSFLTHQHGNDSEAEGEVVCRLPDLEKDDFAARRARMNQTKPMVPLNQLLYGPYPKKGAEKSDGSKQLSKGISKKRSLEYKRNQGHTEEVKLIVTCNMRAQESEPVEGGLRKVPDLHKDDLAQQRIQGSLAPHREPPSFITLSNITEADLETWERLKVSEKARDGDVQHICASEPSPEIKAETAIRDDFANRKARASKKASSPRQKFVHFGPVTELDQQKWKRLSIGKAGPREDEEEVICHGSKIQMDSVSPVSAATSSLKGHQIFNRQNDCRTMNCGRGDYCRRASWLAPVPESQEEWVCSLGECPRGTEEVTSKQLPQDGKEETESAPRDSERLSKAERSEDSSQPLVCPLASECEASGTEEKLEKMTAPAWSGSGLKGQRKLDDSRKDDMMARRTGMSLRHTGSNPNQFLPVPFAKQQDVEESSKGLPMKDQRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 13475 - protein, 897 aa, Homo sapiens
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 13476 - protein, 1069 aa, Homo sapiens
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRSTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQESPGTASVPLRVQNSWRRSQFFSQSVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 13477 - protein, 1057 aa, Homo sapiens
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPQFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 13478 - protein, 409 aa, Homo sapiens
MNLDRCNSIAEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 13479 - protein, 1056 aa, Homo sapiens
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 13480 - protein, 127 aa, Homo sapiens
MFQAAGAAQATPSHDAKGGGSSTVQRSKSFSLRAQVKETCAACQKTVYPMERLVADKLIFHNSCFCCKHCHTKLSLGSYAALHGEFYCKPHFQQLFKSKGNYDEGFGRKQHKELWAHKEVDPGTKTA

SEQ ID NO: 13481 - protein, 647 aa, Homo sapiens
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 13482 - protein, 246 aa, Homo sapiens
MFPVKVKVEKSELEMVKARNQLDAVLQCLLEKSHMDRERLDEEAGKTPSDTHNKDCSIAATGKRPSARFPHQRRKKRREMDDGLAEGGPQRSNTYVIKLFDRSVDLAQFSENTPLYPICRAWMRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 13483 - protein, 116 aa, Homo sapiens
MGWKMASPTDGTDLEASLLSFEKLDRASPDLWPEQLPGVAEFAASFKSPITSSPPKWMAEIERDDIDMLKELGSLTTANLMEKVRGLQNLAYQLGLDESREMTRGKFLNILEKPKK

SEQ ID NO: 13484 - protein, 148 aa, Homo sapiens
MRLGCELGIGFLFGGVAYGTSFSRRRLATSRDMGWKMASPTDGTDLEASLLSFEKLDRASPDLWPEQLPGVAEFAASFKSPITSSPPKWMAEIERDDIDMLKELGSLTTANLMEKVRGLQNLAYQLGLDESREMTRGKFLNILEKPKK

SEQ ID NO: 13485 - protein, 865 aa, Homo sapiens
MSDVSTSVQSKFARLAKKKENITYMKREQLTETDKDIAPVLDLKCKDVSAIMNKFKVLMEIQDLMFEEMRETLKNDLKAVLGGKATIPEVKNSENSSSRTEFQQIINLALQKTGMVGKIEGENSKIGDDNENLTFKLEVNELSGKLDNTNEYNSNDGKKLPQGESRSYEVMGSMEETLCNIDDRDGNRNVHLEFTERESRKDGEDEFVKEMREERKFQKLKNKEEVLKASREEKVLMDEGAVLTLVADLSSATLDISKQWSNVFNILRENDFEPKFLCEVKLAFKCDGEIKTFSDLQSLRKFASQKSSVKELLKDVLPQKEEINQGGRKYGIQEKRDKTLIDSKHRAGEITSDGLSFLFLKEVKVAKPEEMKNLETQEEEFSELEELDEEASGMEDDEDTSGLEEEEEEPSGLEEEEEEEASGLEEDEASGLEEEEEQTSEQDSTFQGHTLVDAKHEVEITSDGMETTFIDSVEDSESEEEEEGKSSETGKVKTTSLTEKKASRRQKEIPFSYLVGDSGKKKLVKHQVVHKTQEEEETAVPTSQGTGTPCLTLCLASPSKSLEMSHDEHKKHSHTNLSISTGVTKLKKTEEKKHRTLHTEELTSKEADLTEETEENLRSSVINSIREIKEEIGNLKSSHSGVLEIENSVDDLSSRMDILEERIDSLEDQIEEFSKDTMQMTKQIISKERQRDIEERSRSCNIRLIGIPEKESYENRAEDIIKEIIDENFAELKKGSSLEIVSACRVPSKIDEKRLTPRHILVKFWNSSDKEKIIRASRERREITYQGTRIRLTADLSLDTLDARSKWSNVFKVLLEKGFNPRILYPAKMAFDFRGKTKVFLSIEEFRDYVLHMPTLRELLGNNIP

SEQ ID NO: 13486 - protein, 757 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLHFTCQRILFLKPSCMLEVITWPIQAFVKRKVIIFLKKCLLCKVGEDLCRGSVPALMPPDHHVAVDMLALANAVLQAVNSGLLKTLSVYEKHSFFGGDEVQPECELITSPDHVILRAASLVIMKSLEIKFQNYSSASEVKVDLQRFMSELLTFLKPHLQPSLQLHNPCKWLSRVFIEQDDDMLEAAKASLGIYLTLTRGCEATESLTQGKEMWDHHTHENGYNPHCIFLFFLKNIGFDSTVLLDFLISSETCFLEYFVRYLKLLQKDWDNFFTICNNFDATESKYDISICGCVPSLVQDQSSNQTIPHRLTAPHSHRDVCARHSWASDAPSEPLKAVMSKGAHTMCASSLSSPRASQSLVDYDSSDDSDVESTEQCLANSKQTSLHQQATKEIQDAAGTSRDKKEFSLEPPSRPLVLKEFDTAFSFDCEVAPNDVVSEVGIFYRIVKCFQELQDAICRLQKKNLFPYNPTALLKLLKYIEVISNKTMNTL

SEQ ID NO: 13487 - protein, 191 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCL

SEQ ID NO: 13488 - protein, 198 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAII

SEQ ID NO: 13489 - protein, 129 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKV

SEQ ID NO: 13490 - protein, 144 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLL

SEQ ID NO: 13491 - protein, 436 aa, Homo sapiens
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLHFTCQRILFLKPSCMLEVITWPIQAFVKRKVIIFLKKCLLCKVGEDLCRGSVPALMPPDHHVAVDMLALANAVLQAVNSGLLKTLSVYEKHSFFGGDEVQPECELITSPDHVILRAASLVIMKSLEIKFQNYSSASEVKGNSPNSFCMQCVIIYLSTVIHNYQISGLV

SEQ ID NO: 13492 - protein, 243 aa, Homo sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 13493 - protein, 243 aa, Homo sapiens; identical to SEQ ID NO: 13492

SEQ ID NO: 13494 - protein, 243 aa, Homo sapiens; identical to SEQ ID NO: 13492

SEQ ID NO: 13495 - protein, 164 aa, Homo sapiens
MVGVVSDDQDFLDSKDTMKMAVVLVTPLGNGDLALKFGYPTPHGGCQKMDTTFTEGAVPGQFSNPAMALSDIRVAFSDYQHFALLYLEMRKGGLRNQWLQLYGGRAAGRRPRHPRFGSGMSPLCLHQPFLHAEGGTAGSWCLWPRVPAPPCPSLPLFAPPAPSL

SEQ ID NO: 13496 - protein, 231 aa, Homo sapiens
MRQPAVRLVRLGRVPYAELLGLQDRWLRRLQAEPGIEAPSGTEAGALLLCEPAGPVYTAGLRGGLTPEETARLRALGAEVRVTGRGGLATFHGPGQLLCHPVLDLRRLGLRLRMHVASLEACAVRLCELQGLQDARARPPPYTGVWLDDRKICAIGVRCGRHITSHGLALNCSTDLTWFEHIVPCGLVGTGVTSLSKELQRHVTVEEVMPPFLVAFKEIYKCTLISEDSPN

SEQ ID NO: 13497 - protein, 282 aa, Homo sapiens
MDRTLESLRHIIAQVLPHRDPALVFKDLNVVSMLQEFWESKQQQKAAFPSEGVVVYESLPAPGPPFVSYVTLPGGSCFGNFQCCLSRAEARRDAAKVALINSLFNELPSRRITKEFIMESVQEAVASTSGTLDDADDPSTSVGAYHYMLESNMGKTMLEFQELMTIFQLLHWNGSLKALRETKCSRQEVISYYSQYSLDEKMRSHMALDWIMKERDSPGIVSQELRMALRQLEEARKAGQELRFYKEKKEILSLALTQICSDPDTSSPSDDQLSLTALCGYH

SEQ ID NO: 13498 - protein, 337 aa, Homo sapiens
METMRAQRLQPGVGTSGRGTLRALRPGVTGAAAATATPPAGPPPAPPPPAPPPPPLLLSGAPGLPLPPGAAGSPAVLREAVEAVVRSFAKHTQGYGRVNVVEALQEFWQMKQSRGADLKNGALVVYEMVPSNSPPYVCYVTLPGGSCFGSFQFCPTKAEARRSAAKIALMNSVFNEHPSRRITDEFIEKSVSEALASFNGNREEADNPNTGIGAFRFMLESNKGKSMLEFQELMTVFQLLHWNGSLKAMRERQCSRQEVLAHYSHRALDDDIRHQMALDWVSREQSVPGALSRELASTERELDEARLAGKELRFHKEKKDILVLAAGQLGNMHSSNC

SEQ ID NO: 13499 - protein, 284 aa, Homo sapiens
METMRAQRLQPGVGTSGRGTLRALRPGVTGAAAATATHTQGYGRVNVVEALQEFWQMKQSRGADLKNGALVVYEMVPSNSPPYVCYVTLPGGSCFGSFQFCPTKAEARRSAAKIALMNSVFNEHPSRRITDEFIEKSVSEALASFNGNREEADNPNTGIGAFRFMLESNKGKSMLEFQELMTVFQLLHWNGSLKAMRERQCSRQEVLAHYSHRALDDDIRHQMALDWVSREQSVPGALSRELASTERELDEARLAGKELRFHKEKKDILVLAAGQLGNMHSSNC

SEQ ID NO: 13500 - protein, 129 aa, Homo sapiens
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRKGKSKAKAVKVAKGLAW

SEQ ID NO: 13501 - protein, 129 aa, Homo sapiens; identical to SEQ ID NO: 13500

SEQ ID NO: 13502 - protein, 137 aa, Homo sapiens
MSQFQGKGPRWTVLIMSKVGLRGGLSDQMAMKVLDPLRQALDSSMQSNNLCQHPQPLALHVSAAVASAGAQASSLLGPLPHLSSFAFQPAHSLLSLLGSHGAEVSKKMALLARERSPAHLVAFPGRLTATPPGLPTF

SEQ ID NO: 13503 - protein, 65 aa, Homo sapiens
MKKDSQGAFSGFCHGGDALHEGRVRRPLWLKDMYKPLSATRVNNHAWKLHKKSSNEDEILNRDPG

SEQ ID NO: 13504 - protein, 605 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEIAS

SEQ ID NO: 13505 - protein, 808 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 13506 - protein, 581 aa, Homo sapiens
MLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 13507 - protein, 773 aa, Homo sapiens
MSSPAVARTSPGGSREMAPAPQGRGRFWEVGGGSGHRLERAAAESERWELLLRRGELLALGGHLKGALEAFAAALRRGAPARPECLGALVDCLVFNYRLRHGLGWSAAPVAGADGGAGGLLRCLGCRGFLSEPVTVPCGHSYCRRCLRRELRARCRLCRDRLPPATASATDAEGTAPRPPPLAAAIAASDFRTSVVLNHLAEKWFPGQRERARAAGRLGELLHQGRYREALAAACEALRAEPSDLIVKIYRAESYAGLQEFKAAIEDLNAVLFQLPDWPEVYFRKGKVLCDAGFLGDALQLFLQCLALDEDFAPAKLQVQKILCDLLLPENLKEGLKESSWSSLPCTKNRPFDFHSVMEESQSLNEPSPKQSEEIPEVTSEPVKGSLNRAQSAQSINSTEMPAREDCLKRVSSEPVLSVQEKGVLLKRKLSLLEQDVIVNEDGRNKLKKQGETPNEVCMFSLAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 13508 - protein, 754 aa, Homo sapiens
MSPEPVPPPPPPQCPGCDRAEPIAQRLEEGDEAFRAGDYEMAAELFRSMLAGLAQPDRGLCLRLGDALARAGRLPEALGAFRGAARLGALRPEELEELAGGLVRAVGLRDRPLSAENPGGEPEAPGEGGPAPEPRAPRDLLGCPRCRRLLHKPVTLPCGLTVCKRCVEPGPARPQVRRVNVVLSGLLEKCFPAECRLRRLAGQARSLQRQQQPEAALLRCDQALELAPDDNSLLLLRAELYLTMKNYEQALQDASAACQNEPLLIKGHQVKAQALSGLGRSKEVLKEFLYCLALNPECNSVKKEAQKVMCEVLFSATANVHENLTSSIQSRLKAQGHSHMNAQALLEEGDAGSSENSSEKSDMLGNTNSSVLYFILGLHFEEDKKALESILPTAPSAGLKRQFPDDVEDAPDLNAPGKIPKKDLSLQRSPNSETEESQGLSLDVTDFECALCMRLLFEPVTTPCGHTFCLKCLERCLDHAPHCPLCKDKLSELLASRNFNITVLAEELIFRYLPDELSDRKRIYDEEMSELSNLTRDVPIFVCAMAFPTVPCPLHVFEPRYRLMIRRCMETGTKRFGMCLSAEHAGLSEYGCMLEIKDVRTFPDGSSVVDAIGISRFRVLSHRHRDGYNTADIEYLEDEKVEGPEYEELAALHDSVHQQSVSWFASLQDRMKEQILSHFGVMPDREPEPQSNPSGPAWSWWILAVLPLERKAQLAILGMTSLKERLLAIRRILVIITRKMNSRQELANARERNN

SEQ ID NO: 13509 - protein, 511 aa, Homo sapiens
MKNYEQALQDASAACQNEPLLIKGHQVKAQALSGLGRSKEVLKEFLYCLALNPECNSVKKEAQKVMCEVLFSATANVHENLTSSIQSRLKAQGHSHMNAQALLEEGDAGSSENSSEKSDMLGNTNSSVLYFILGLHFEEDKKALESILPTAPSAGLKRQFPDDVEDAPDLNAPGKIPKKDLSLQRSPNSETEESQGLSLDVTDFECALCMRLLFEPVTTPCGHTFCLKCLERCLDHAPHCPLCKDKLSELLASRNFNITVLAEELIFRYLPDELSDRKRIYDEEMSELSNLTRDVPIFVCAMAFPTVPCPLHVFEPRYRLMIRRCMETGTKRFGMCLSAEHAGLSEYGCMLEIKDVRTFPDGSSVVDAIGISRFRVLSHRHRDGYNTADIEYLEDEKVEGPEYEELAALHDSVHQQSVSWFASLQDRMKEQILSHFGVMPDREPEPQSNPSGPAWSWWILAVLPLERKAQLAILGMTSLKERLLAIRRILVIITRKMNSRQELANARERNN

SEQ ID NO: 13510 - protein, 718 aa, Homo sapiens
MESVRIEQMLSLPAEVSSDNLESAERGASAAQVDMGPHPKVAAEGPAPLPTREPEQEQSPGTSTPESKVLLTQADALASRGRIREALEVYRQLSERQQLVAEQLEQLVRCLAEKVPQGEALAPAPPDEGSTASGTVAAEETGAAAAAAATEVWDGFKCRKCHGFLSDPVSLSCGHTFCKLCLERGRAADRRCALCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 13511 - protein, 718 aa, Homo sapiens; identical to SEQ ID NO: 13510

SEQ ID NO: 13512 - protein, 759 aa, Homo sapiens
MESVRIEQMLSLPAEVSSDNLESAERGASAAQVDMGPHPKVAAEGPAPLPTREPEQEQSPGTSTPESKVLLTQADALASRGRIREALEVYRQLSERQQLVAEQLEQLVRCLAEKVPQGEALAPAPPDEGSTASGTVAAEETGAAAAAAATEVWDGFKCRKCHGFLSDPVSLSCGHTFCKLCLERGRAADRRCALCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKAHFRKAQALATLGKVEEALREFLYCVSLDGKNKRARCEAQRDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 13513 - protein, 503 aa, Homo sapiens
MGFKAHFRKAQALATLGKVEEALREFLYCVSLDGKNKRARCEAQRLLLSFFSPSVPGDSQEHSPDILKLLAPHPRLKENVESMTTEVTSHNLPRLLQDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 13514 - protein, 525 aa, Homo sapiens
  MOD_RES (1)..(1): Any amino acid
XCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 13515 - protein, 462 aa, Homo sapiens
MGAAGRATRLVGGREQRGAVGGGWWGGEPDIPYTHTTEHPPMGSPLPNLRAHVRTGRPPDPCTAAARDRRPLGRGGRGAAQTFGQRTRGGPRCPGSHRQRPPSMKAAPRLPHRLRHRGQPPEPSSLRALHADPIPSGLSPGPCGAPPTWSGRRAPGDRDNRPTSGPWQRHTRRSRVWSQRGPPQPKLVSRSGREDTRAGRGAQTGKARDRKGKGTREPAEGRLGKKPQAKPGHQENTATGSHRHRYEGGPAAPRLGSRTAPGTHRDPPHEPGSRHRDPEATSATNPTPGPRCWFLVHPPTLSSSGRPARPPLGMLPMARHPNPVPRKRGCRHRSLLLRGAGGEPARSGAGHAPDGTPGTATARAASQPLGRRPGPAGSSPDSEGGGAGHTVGDEPPSVPTAEDSLKRESVRDSSFSPESSEVDGGLCSELLWFQLAARRREISNVSREARATVIEPRKWRLQ

SEQ ID NO: 13516 - protein, 164 aa, Homo sapiens
MRPQPRGGSGRKENTGEEREGRAERYHAISADGERRLQPGTAVLTRHVSFLFGGREAEEHVMETDRVEGARDGDKRKEVCFVPIQGSFCFMRLTCARLVAALDIHGLSFSLRFCGSRDTKHEDITGREGQVTPLPRGTPQLCTARVGLSSPRTRGQGVPISCKT

SEQ ID NO: 13517 - protein, 86 aa, Homo sapiens
MVRHPYSVQTQLSTEAKAIWRSMQQQETNLLANLTTNDARDNSKDFQNSKVGAAATSRDEGCNCPIIGEIVISCYWLFEIPPLISR

SEQ ID NO: 13518 - protein, 63 aa, Homo sapiens
QQQETNLLANLTTNDARDNSKDFQNSKVGAAATSRDEGCNCPIIGEIVISCYWLFEIPPLISE

SEQ ID NO: 13519 - protein, 82 aa, Homo sapiens
MQCLYFILILKGYFHQQHHTLLITIALCFLQQQQETNLLANLTTNDARDNSKDFQNSKVGAAATSRDEGETQKCIQKPLHEK

SEQ ID NO: 13520 - protein, 264 aa, Homo sapiens
MPRSLKRAQLRSLLPRPPAVSHTQPWYRAAHPTTSPTAASRDVHPASGAVPGPWLVEGTAVREGPQLQDAVPQRPTRPSKALWPAQMSAAPAIRLGQMVPGDTRGLWGPQGTLLTWTYRGGQGGRWTRRAEGPREGTFAEQRPHFQSSGAQQESRLAMGPPPLGLGDAAGDGRGQTGQEKGRAEGRQARKSACKCPRKGPNPGPWTRAAAWWGRLEGAKASAKGEQVRDPGGHLWEQGHVSPCARFNQGHSCGSPKVSHTTWVS

SEQ ID NO: 13521 - protein, 148 aa, Homo sapiens
MGSEQSSEAESRPNDLNSSGLLSGQTSPTNAKLEKLDSQQVLQLCLRYQDHLHQCAEAVAFDQNALVKRIKEMDLSVETLFSFMQERQKRYAKYAEQIQKVNEMSAILRRIQMGIDQTVPLLDRLNSMLPEGERLEPFSMKPDRELRL

SEQ ID NO: 13522 - protein, 196 aa, Homo sapiens
MGSEQSSEAESRPNDLNSSVTPSPAKHRAKMDDIVVVAQGSQASRNVSNDPDVIKLQEIPTFQPLLKGLLSGQTSPTNAKLEKLDSQQVLQLCLRYQDHLHQCAEAVAFDQNALVKRIKEMDLSVETLFSFMQERQKRYAKYAEQIQKVNEMSAILRRIQMGIDQTVPLLDRLNSMLPEGERLEPFSMKPDRELRL

SEQ ID NO: 13523 - protein, 166 aa, Homo sapiens
MQGTRAELSAHSPSRAAGNRRHEQGLPPGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 13524 - protein, 162 aa, Homo sapiens
MNKVFPQGENGYTAAESKAHPGGEGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 13525 - protein, 252 aa, Homo sapiens
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRANLDRQELRVLVNASLGWPNGLALDLQEGKLYWGDAKTDKIEAISVDETKRQTLLKDKLPHIFRFTLLGDFIYWTAWQHHSIKRVHKVKANRDVIIDQLPDLMGLKAVNVDKVVGTNPHADRNGGAATCASSRPTQPGLAAPSRAWNC

SEQ ID NO: 13526 - protein, 252 aa, Homo sapiens; identical to SEQ ID NO: 13525

SEQ ID NO: 13527 - protein, 224 aa, Homo sapiens
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRANLDRQELRVLVNASLGWPNGLALDLQEGKLYWGDAKTDKIEAISVDETKRQTLLKDKLPHIFRFTLLGDFIYWTAWQHHSIKRVHKVKANRDVIIDQLPDLMGLKAVNVDKVVGPGTAE

SEQ ID NO: 13528 - protein, 3 aa, Homo sapiens
MEG

SEQ ID NO: 13529 - protein, 385 aa, Homo sapiens
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLEKLVSPPASAAASSPSSSPSPQPVSELDLSSEPQQLTAKGNSSLGELHAVLQTILRARGKAADRMTVAVADHLPSPCSRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 13530 - protein, 385 aa, Homo sapiens
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 13531 - protein, 223 aa, Homo sapiens
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASGNRRTRNRSRGQNRPTNVKENTIKF

SEQ ID NO: 13532 - protein, 248 aa, Homo sapiens
MAPYGPLAASSLLSQQYAASLGLEKLVSPPASAAASSPSSSPSPQPVSELDLSSEPQQLTAKGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKT

SEQ ID NO: 13533 - protein, 239 aa, Homo sapiens
MAPYGPLAASSLLSQQYAASLGLEKLVSPPASAAASSPSSSPSPQPVSELDLSSEPQQLTAKGCLFCFRSLFTYTQSHIVLFRVPTGPGTLEREEMERGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKRPILLLVFWT

SEQ ID NO: 13534 - protein, 221 aa, Homo sapiens
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLEKLVSPPASAAASSPSSSPSPQPVSELDLSSEPQQLTAKGNSSLGELHAVLQTILRARGKAADRMTVAVADHLPSPCSR

SEQ ID NO: 13535 - protein, 296 aa, Homo sapiens
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQLNKRPDEGVRGDGMAFAVLTRCLVVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKE

SEQ ID NO: 13536 - protein, 230 aa, Homo sapiens
MAPYGPLAASSLLSQQYAASLGLEKLVSPPASAAASSPSSSPSPQPVSELDLSSEPQQLTAKGCLFCFRSLFTYTQSHIVLFRVPTGPGTLEREEMERGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKK

SEQ ID NO: 13537 - protein, 385 aa, Homo sapiens; identical to SEQ ID NO: 13530

SEQ ID NO: 13538 - protein, 475 aa, Homo sapiens
MPHRKKKPFIEKKKAVSFHLVHRSQRDPLAADESAPQRVLLPTQKIDNEERRAEQRKYGVFFDDDYDYLQHLKEPSGPSELIPSSTFSAHNRREEKEETLVIPSTGIKLPSSVFASEFEEDVGLLNKAAPVSGPRLDFDPDIVAALDDDFDFDDPDNLLEDDFILQANKATGEEEGMDIQKSENEDDSEWEDVDDEKGDSNDDYDSAGLLSDEDCMSVPGKTHRAIADHLFWSEETKSRFTEYSMTSSVMRRNEQLTLHDERFEKFYEQYDDDEIGALDNAELEGSIQVDSNRLQEVLNDYYKEKAENCVKLNTLEPLEDQDLPMNELDESEEEEMITVVLEEAKEKWDCESICSTYSNLYNHPQLIKYQPKPKQIRISSKTGIPLNVLPKKGLTAKQTERIQMINGSDLPKVSTQPRSKNESKEDKRARKQAIKEERKERRVEKKANKLAFKLEKRRQEKELLNLKKNVEGLKL

SEQ ID NO: 13539 - protein, 237 aa, Homo sapiens
MKGILVAGITAVLVAAVESLSCVQCNSWEKSCVNSIASECPSHANTSCISSSASSSLETPVRLYQNMFCSAENCSEETHITAFTVHVSAEEHFHFVSQCCQGKECSNTSDALDPPLKNVSSNAECPACYESNGTSCHGKPWKCYEEEQCVFLVAELKNDIESKSLVLKGCSNVSNATCQFLSGENKTLGGVIFRKFECANVNSLTPTSAPTTSHNVGSKASLYLLALASLLLRGLLP

SEQ ID NO: 13540 - protein, 1873 aa, Homo sapiens
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLDCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 13541 - protein, 1817 aa, Homo sapiens
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 13542 - protein, 165 aa, Homo sapiens
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 13543 - protein, 212 aa, Homo sapiens
DFGYCPRVYCENQPMLPIGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELCRMYLFLNSSGLLVLPQAGLLTPHPS

SEQ ID NO: 13544 - protein, 212 aa, Homo sapiens
DFGYCPRVYCENQPMLPIGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 13545 - protein, 228 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPSSCSRHPDVPLLPRRRPFCRMHFRLREVYHQQLIPVHGDHHLL

SEQ ID NO: 13546 - protein, 212 aa, Homo sapiens; identical to SEQ ID NO: 13544

SEQ ID NO: 13547 - protein, 212 aa, Homo sapiens; identical to SEQ ID NO: 13543

SEQ ID NO: 13548 - protein, 228 aa, Homo sapiens; identical to SEQ ID NO: 13545

SEQ ID NO: 13549 - protein, 201 aa, Homo sapiens [sequence omitted]

SEQ ID NO: 13550 - protein, 201 aa, Homo sapiens [sequence omitted]

SEQ ID NO: 13551 - protein, 100 aa, Homo sapiens
MGTSSIFLCVLFLCGALGLTMSPARGRLRCYICGFTKPCHPVPTECRDDEACGISIGTSGRTLVQWPFSRRLPTSIHPAFPVAPASACLFHPTDQSEITE

SEQ ID NO: 13552 - protein, 125 aa, Homo sapiens
MGTSSIFLCVLFLCGALGLTMSPARGRLRCYICGFTKPCHPVPTECRDDEACGISIGTSGKSCLSRAQCPLPGYATYWLHSYTLWHHCCEQDLCNIAASPQQLTSLLASLPLFVASFAGRGHLLH

SEQ ID NO: 13553 - protein, 100 aa, Homo sapiens; identical to SEQ ID NO: 13551

SEQ ID NO: 13554 - protein, 66 aa, Homo sapiens
MGTSSIFLCVLFLCGALGLTMSPARGRLRCYICGFTKPCHPVPTECRDDEACGISIGTSDQSEITE

SEQ ID NO: 13555 - protein, 66 aa, Homo sapiens; identical to SEQ ID NO: 13554

SEQ ID NO: 13556 - protein, 66 aa, Homo sapiens; identical to SEQ ID NO: 13554

SEQ ID NO: 13557 - protein, 100 aa, Homo sapiens; identical to SEQ ID NO: 13551

SEQ ID NO: 13558 - protein, 100 aa, Homo sapiens; identical to SEQ ID NO: 13551

SEQ ID NO: 13559 - protein, 66 aa, Homo sapiens; identical to SEQ ID NO: 13554

SEQ ID NO: 13560 - protein, 66 aa, Homo sapiens; identical to SEQ ID NO: 13554

SEQ ID NO: 13561 - protein, 100 aa, Homo sapiens; identical to SEQ ID NO: 13551

SEQ ID NO: 13562 - protein, 66 aa, Homo sapiens; identical to SEQ ID NO: 13554

SEQ ID NO: 13563 - protein, 100 aa, Homo sapiens; identical to SEQ ID NO: 13551

SEQ ID NO: 13564 - protein, 128 aa, Homo sapiens
MGTSSIFLCVLFLCGALGLTMSPARGRLRCYICGFTKPCHPVPTECRDDEACGISIGTSVKKLPLKGPVPSARLCHLLAALLHSVAPLLRAGPVQHSRFPTAAHQPPRLPAPLCGQLRWERTPPPLAS

SEQ ID NO: 13565 - protein, 125 aa, Homo sapiens; identical to SEQ ID NO: 13552

SEQ ID NO: 13566 - protein, 125 aa, Homo sapiens; identical to SEQ ID NO: 13552

SEQ ID NO: 13567 - protein, 125 aa, Homo sapiens; identical to SEQ ID NO: 13552

SEQ ID NO: 13568 - protein, 125 aa, Homo sapiens; identical to SEQ ID NO: 13552

SEQ ID NO: 13569 - protein, 125 aa, Homo sapiens; identical to SEQ ID NO: 13552

SEQ ID NO: 13570 - protein, 125 aa, Homo sapiens; identical to SEQ ID NO: 13552

SEQ ID NO: 13571 - protein, 297 aa, Homo sapiens [sequence omitted]

SEQ ID NO: 13572 - protein, 297 aa, Homo sapiens [sequence omitted]

SEQ ID NO: 13573 - protein, 382 aa, Homo sapiens
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCTVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSTCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 13574 - protein, 78 aa, Homo sapiens; identical to SEQ ID NO: 10194

SEQ ID NO: 13575 - protein, 523 aa, Homo sapiens
METMKSKANCAQNPNCNIMIFHPTKEEFNDFDKYIAYMESQGAHRAGLAKIIPPKEWKARETYDNISEILIATPLQQVASGRAGVFTQYHKKKKAMTVGEYRHLANSKKYQTPPHQNFEDLERKYWKNRIYNSPIYGADISGSLFDENTKQWNLGHLGTIQDLLEKECGVVIEGVNTPYLYFGMWKTTFAWHTEDMDLYSINYLHLGEPKTWYVVPPEHGQRLERLARELFPGSSRGCGAFLRHKVALISPTVLKENGIPFNRITQEAGEFMVTFPYGYHAGFNHGFNCAEAINFATPRWIDYGKMASQCSCGEARVTFSMDAFVRILQPERYDLWKRGQDRAVVDHMEPRVPASQELSTQKEVQLPRRAALGLRQLPSHWARHSPWPMAARSGTRCHTLVCSSLPRRSAVSGTATQPRAAAVHSSKKPSSTPSSTPGPSAQIIHPSNGRRGRGRPPQKLRAQELTLQTPAKRPLLAGTTCTASGPEPEPLPEDGALMDKPVPLSPGLQHPVKASGCSWAPVP

SEQ ID NO: 13576 - protein, 259 aa, Homo sapiens
MKHSKKTYDSFQDELEDYIKVQKARGLEPKTCFRKMKGDYLETCGYKGEVNSRPTYRMFDQRLPSETIQTYPRSCNIPQTVENRLPQWLPAHDSRLRLDSLSYCQFTRDCFSEKPVPLNFNQQEYICGSHGVEHRVYKHFSSDNSTSTHQASHKQIHQKRKRHPEEGREKSEEERSKHKRKKSCEEIDLDKHKSIQRKKTEVEIETVHVSTEKLKNRKEKKSRDVVSKKEERKRTKKKKEQGQERTEEEMLWDQSILGF

SEQ ID NO: 13577 - protein, 227 aa, Homo sapiens
MASPSRQPPPGGSGLLQGSRARSYGSLVQSACSPVRERRLEHQLEPGDTLAGLALKYGVTMEQIKRANRLYTNDSIFLKKTLYIPILTEPRDLFNGLDSEEEKDGEEKVHPSNSEVWPHSTERKKQETGAGRANGEVLPTPGQETPTPIHDLSASDFLKKLDSQISLSKKAAAQKLKKGENGVPGEDAGLHLSSPWMQQRAVLGPVPLTRTSRTRTLRDQEDEIFKL

SEQ ID NO: 13578 - protein, 179 aa, Homo sapiens
MRSGPLRISEWKMEQIKRANRLYTNDSIFLKKTLYIPILTEPRDLFNGLDSEEEKDGEEKVHPSNSEVWPHSTERKKQETGAGRANGEVLPTPGQETPTPIHDLSASDFLKKLDSQISLSKKAAAQKLKKGENGVPGEDAGLHLSSPWMQQRAVLGPVPLTRTSRTRTLRDQEDEIFKL

SEQ ID NO: 13579 - protein, 215 aa, Homo sapiens
MADSSPALSLREGGPRAPRPSAPSPPPRSRSGSESEEAELSLSLARTKTRSYGSTASVRAPLGAGVIERHVEHRVRAGDTLQGIALKYGVTMEQIKRANKLFTNDCIFLKKTLNIPVISEKPLLFNGLNSIDSPENETADNSFSQEEEPVVAGEDLPPPSPQESDVQPVQPEEVSARDFLQRLDLQIKLSTQAAKKLKEESRDEESPYATSLYHS

SEQ ID NO: 13580 - protein, 124 aa, Homo sapiens
MEQIKRANKLFTNDCIFLKKTLNIPVISEKPLLFNGLNSIDSPENETADNSFSQEEEPVVAGEDLPPPSPQESDVQPVQPEEVSARDFLQRLDLQIKLSTQAAKKLKEESRDEESPYATSLYHS

SEQ ID NO: 13581 - protein, 124 aa, Homo sapiens; identical to SEQ ID NO: 13580

SEQ ID NO: 13582 - protein, 164 aa, Homo sapiens
MKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 13583 - protein, 180 aa, Homo sapiens
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQVNVPTDPPALCVCILVAWGLLQH

SEQ ID NO: 13584 - protein, 182 aa, Homo sapiens
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQGPVQDIPGCHAQLLSSGDGSCEGIS

SEQ ID NO: 13585 - protein, 137 aa, Homo sapiens
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENRRGPVPLHGPHLPPPSGWHRGVELLAASAPGLPPGECPH

SEQ ID NO: 13586 - protein, 208 aa, Homo sapiens
MLPPCLELSGKRPRHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 13587 - protein, 231 aa, Homo sapiens
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 13588 - protein, 134 aa, Homo sapiens
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENRRGPVPLHGPHLPPPSGWHRGVELLAASAPGLPPGS

SEQ ID NO: 13589 - protein, 162 aa, Homo sapiens
MLPPCLELSGKRPRHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGA

SEQ ID NO: 13590 - protein, 91 aa, Homo sapiens
MCGNTMSVPLLTDAATVSGAERETAAVIFLHGLGDTGHSWADALSTIRLPHVKYICPHAPRIPVTLNMKMVMPSWFDLMGLSPDAPEDEAG

SEQ ID NO: 13591 - protein, 491 aa, Homo sapiens
MKMAAPTANKAASLGCNNKPAFPELDFRSGARVEELNKLIQEFTKHDQREYDDQRALEIHTAKDFIFSMLGMVQKLDQKLPVANEYLLLSGGVREGVVDLDLDELNVYARGTDYDMDFTLLVPALKLHDRNQPVTLDMRHSALCHSWLSLRLFDEGTISKWKDCCTIVDHINGATNYFFSPTKVADWFYDSISIVLSEIQKKPQRGMPKVEKVEKNGTIISIILGVGSSRMLYDIVPVVSFKGWPAVAQSWLMENHFWDGKITEEEVISGFYLVPACSYKGKKDNEWRLSFARSEVQLKKCISSSLMQAYQACKAIIIKLLSRPKAISPYHLRSMMLWACDRLPANYLAQEDYAAHFLLGLIDDLQHCLVNKMCPNYFIPQCNMLEHLSEETVMLHARKLSSVRSDPAEHLRTAIEHVKAANRLTLELQRRGSTTSIPSPQSDGGDPNQPDDRLAKKLQQLVTENPGKSISVFINPDDVTRPHFRIDDKFF

SEQ ID NO: 13592 - protein, 362 aa, Homo sapiens [sequence omitted]

SEQ ID NO: 13593 - protein, 1456 aa, Homo sapiens
MRLPLLLVFASVIPGAVLLLDTRQFLIYNEDHKRCVDAVSPSAVQTAACNQDAESQKFRWVSESQIMSVAFKLCLGVPSKTDWVAITLYACDSKSEFQKWECKNDTLLGIKGEDLFFNYGNRQEKNIMLYKGSGLWSRWKIYGTTDNLCSRGYEAMYTLLGNANGATCAFPFKFENKWYADCTSAGRSDGWLWCGTTTDYDTDKLFGYCPLKFEGSESLWNKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGSDLASIHTIEEFDFIISQLGYEPNDELWIGLNDIKIQMYFEWSDGTPVTFTKWLRGEPSHENNRQEDCVVMKGKDGYWADRGCEWPLGYICKMKSRSQGPEIVEVEKGCRKGWKKHHFYCYMIGHTLSTFAEANQTCNNENAYLTTIEDRYEQAFLTSFVGLRPEKYFWTGLSDIQTKGTFQWTIEEEVRFTHWNSDMPGRKPGCVAMRTGIAGGLWDVLKCDEKAKFVCKHWAEGVTHPPKPTTTPEPKCPEDWGASSRTSLCFKLYAKGKHEKKTWFESRDFCRALGGDLASINNKEEQQTIWRLITASGSYHKLFWLGLTYGSPSEGFTWSDGSPVSYENWAYGEPNNYQNVEYCGELKGDPTMSWNDINCEHLNNWICQIQKGQTPKPEPTPAPQDNPPVTEDGWVIYKDYQYYFSKEKETMDNARAFCKRNFGDLVSIQSESEKKFLWKYVNRNDAQSAYFIGLLISLDKKFAWMDGSKVDYVSWATGEPNFANEDENCVTMYSNSGFWNDINCGYPNAFICQRHNSSINATTVMPTMPSVPSGCKEGWNFYSNKCFKIFGFMEEERKNWQEARKACIGFGGNLVSIQNEKEQAFLTYHMKDSTFSAWTGLNDVNSEHTFLWTDGRGVHYTNWGKGYPGGRRSSLSYEDADCVVIIGGASNEAGKWMDDTCDSKRGYICQTRSDPSLTNPPATIQTDGFVKYGKSSYSLMRQKFQWHEAETYCKLHNSLIASILDPYSNAFAWLQMETSNERVWIALNSNLTDNQYTWTDKWRVRYTNWAADEPKLKSACVYLDLDGYWKTAHCNESFYFLCKRSDEIPATEPPQLPGRCPESDHTAWIPFHGHCYYIESSYTRNWGQASLECLRMGSSLVSIESAAESSFLSYRVEPLKSKTNFWIGLFRNVEGTWLWINNSPVSFVNWNTGDPSGERNDCVALHASSGFWSNIHCSSYKGYICKRPKIIDAKPTHELLTTKADTRKMDPSKPSSNVAGVVIIVILLILTGAGLAAYFFYKKRRVHLPQEGAFENTLYFNSQSSPGTSDMKDLVGNIEQNEHSVI

SEQ ID NO: 13594 - protein, 498 aa, Homo sapiens
MRLPLLLVFASVIPGAVLLLDTRQFLIYNEDHKRCVDAVSPSAVQTAACNQDAESQKFRWVSESQIMSVAFKLCLGVPSKTDWVAITLYACDSKSEFQKWECKNDTLLGIKGEDLFFNYGNRQEKNIMLYKGSGLWSRWKIYGTTDNLCSRGYEAMYTLLGNANGATCAFPFKFENKWYADCTSAGRSDGWLWCGTTTDYDTDKLFGYCPLKFEGSESLWNKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGSDLASIHTIEEFDFIISQLGYEPNDELWIGLNDIKIQMYFEWSDGTPVTFTKWLRGEPSHENNRQEDCVVMKGKAGVQWHNLGSMQPLPREFKRFSCLSLPSS

SEQ ID NO: 13595 - protein, 168 aa, Homo sapiens
TGQGGVRSAPGTGRIAFPPKASRGSTNTAHLSIANSWPRSASTPETRTKFTQDNLCHAQRERLDSANLWVLVDCILRDTSEDLGLQCDAVNLAFGRRCEELEDARHKLQHHLHKVGHPEPRRRLRRLPTTLPPLITWPGPSTPFSSVPLIPRDPRSKCHLSVNLCKTR

SEQ ID NO: 13596 - protein, 646 aa, Homo sapiens
MEFQEVQQTQALAWQAQKAPTHIWQPLPAQEAQRQAPPLVQLEQPFQGAPPSQKAVQIQLPPQQAQASGPQAEVPTLPLQPSWQAPPAVLQAQPGPPVAAANFPLGSAKSLMTPSGECRASSIDRRGSSKERRTSSKERRAPSKDRMIFAATFCAPKAVSAARAHLPAAWKNLPATPETFAPSSSVFPATSQFQPASLNAFKGPSAASETPKSLPYALQDPFACVEALPAVPWVPQPNMNASKASQAVPTFLMATAAAPQATATTQEASKTSVEPPRRSGKATRKKKHLEAQEDSRGHTLAFHDWQGPRPWENLNLSDWEVQSPIQVSGDWEHPNTPRGLSGWEGPSTSRILSGWEGPSASWALSAWEGPSTSRALGLSESPGSSLPVVVSEVASVSPGSSATQDNSKVEAQPLSPLDERANALVQFLLVKDQAKVPVQRSEMVKVILREYKDECLDIINRANNKLECAFGYQLKEIDTKNHAYIIINKLGYHTGNLVASYLDRPKFGLLMVVLSLIFMKGNCVREDLIFNFLFKLGLDVRETNGLFGNTKKLITEVFVRQKYLEYRRIPYTEPAEYEFLWGPRAFLETSKMLVLRFLAKLHKKDPQSWPFHYLEALAECEWEDTDEDEPDTGDSAHGPTSRPPPR

SEQ ID NO: 13597 - protein, 275 aa, Homo sapiens
MPLLWITGPRYHLILLSEASCLRANYVHLCPLFQHRWLETCNAPPQLIQGKAHSAPKPSQASGHFSVELVRGYAGFGLTLGGGRDVAGDTPLAVRGLLKDGPAQRCGRLEVGDVVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQFAQEMAAGRRRH

SEQ ID NO: 13598 - protein, 270 aa, Homo sapiens
MPLLWITGPRYHLILLSEASCLRANYVHLCPLFQHRWLETCNAPPQLIQGKAHSAPKPSQASGHFSVELVRGYAGFGLTLGGGRDVAGDTPLAVRGLLKDGPAQRCGRLEVGDVVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSPEAAADGPTVSPPERRAEDPNDQIPGSPGPWLVPSEERLSRALGVRGAAQFAQEMAAGRRRH

SEQ ID NO: 13599 - protein, 334 aa, Homo sapiens
MEPRTGGAANPKGSRGSRGPSPLAGPSARQLLARLDARPLAARAAVDVAALVRRAGATLRLRRKEAVSVLDSADIEVTDSRLPHATIVDHRPQHRWLETCNAPPQLIQGKAHSAPKPSQASGHFSVELVRGYAGFGLTLGGGRDVAGDTPLAVRGLLKDGPAQRCGRLEVGDVVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQFAQEMAAGRRRH

SEQ ID NO: 13600 - protein, 237 aa, Homo sapiens
  MOD_RES (1)..(1): Any amino acid
XRGPSPLAGPSARQLLARLDARPLAARAAVDVAALVRRAGATLRLRRKEAVSVLDSADIEVTDSRLPHATIVDHRPQGKAHSAPKPSQASGHFSVELVRGYAGFGLTLGGGRDVAGDTPLAVRGLLKDGPAQRCGRLEVGDVVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSP

SEQ ID NO: 13601 - protein, 214 aa, Homo sapiens
AWGVSSYCPVLAVSVLDSADIEVTDSRLPHATIVDHRPQHRWLETCNAPPQLIQGKAHSAPKPSQASGHFSVELVRGYAGFGLTLGGGRDVAGDTPLAVRGLLKDGPAQRCGRLEVGDVVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSP

SEQ ID NO: 13602 - protein, 258 aa, Homo sapiens
MEPRTGGAANPKGSRGSRGPSPLAGPSARQLLARLDARPLAARAAVDVAALVRRAGATLRLRRKEAVSVLDSADIEVTDSRLPHATIVDHRPQVGDVVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQFAQEMAAGRRRH

SEQ ID NO: 13603 - protein, 143 aa, Homo sapiens
MSPNSPLHCFYLPAVSVLDSADIEVTDSRLPHATIVDHRPQVGDVVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSPEAA

SEQ ID NO: 13604 - protein, 201 aa, Homo sapiens
  MOD_RES (1)..(1): Any amino acid
XGRLLAMEPRTGGAANPKGSRGSRGPSPLAGPSARQLLARLDARPLAARAAVDVAALVRRAGATLRLRRKEAVSVLDSADIEVTDSRLPHATIVDHRPQVGDVVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSPEAA

SEQ ID NO: 13605 - protein, 176 aa, Homo sapiens
MARLPKLAVFDLDYTLWPFWVDTHVDPPFHKSSDGTVRDRRGQDVRLYPEVPEVLKRLQSLGVPGAAASRTSEIEGANQLLELFDLFRYFVHREIYPGSKITHFERLQQKTGIPFSQMIFFDDERRNIVDVSKLGVTCIHIQNGMNLQTLSQGLETFAKAQTGPLRSSLEESPFEA

SEQ ID NO: 13606 - protein, 122 aa, Homo sapiens
MARLPKLAVFDLDYTLWPFWVDTHVDPPFHKSSDGTVRDRRGQDVRLYPEVPEVLKRLQSLGVPGAAASRTSEIEGANQLLELFDLFRCYLHSHPEWNESSNSKSRVRDICEGPNWAFEVQP

SEQ ID NO: 13607 - protein, 504 aa, Homo sapiens
MAAPPAPAAKGSPQPEPHAPEPGPGSAKRGREDSRAGRLSFCTKVCYGIGGVPNQIASSATAFYLQLFLLDIAQIPAAQVSLVLFGGKVSGAAADPVAGFFINRSQRTGSGRLMPWVLGCTPFIALAYFFLWFLPPFTSLRGLWYTTFYCLFQALATFFQVPYTALTMLLTPCPRERDSATAYRMTVEMAGTLMGATVHGLIVSGAHRPHRCEATATPGPVTVSPNAAHLYCIAAAVVVVTYPVCISLLCLGVKERPDPSAPASGPGLSFLAGLSLTTRHPPYLKLVISFLFISAAVQVEQSYLVLFCTHASQLHDHVQGLVLTVLVSAVLSTPLWEWVLQRFGKKTSAFGIFAMVPFAILLAAVPTAPVAYVVAFVSGVSIAVSLLLPWSMLPDVVDDFQLQHRHGPGLETIFYSSYVFFTKLSGACALGISTLSLEFSGYKAGVCKQAEEVVVTLKVLIGAVPTCMILAGLCILMVGSTPKTPSRDASSRLSLRRRTSYSLA

SEQ ID NO: 13608 - protein, 497 aa, Homo sapiens
MAAPPAPAAKGSPQPEPHAPEPGPGSAKRGREDSRAGRLSFCTKVCYGIGGVPNQIASSATAFYLQLFLLDIAQIPAAQVSLVLFGGKVSGAAADPVAGFFINRSQRTGSGRLMPWVLGCTPFIALAYFFLWFLPPFTSLRGLWYTTFYCLFQALATFFQVPYTALTMLLTPCPRERDSATAYRMTVEMAGTLMGATVHGLIVSGAHRPHRCEATATPGPVTVSPNAAHLYCIAAAVVVVTYPVCISLLCLGVKERPDPSAPASGPGLSFLAGLSLTTRHPPYLKLVISFLFISAAVQVEQSYLVLFCTHASQLHDHVQGLVLTVLVSAVLSTPLWEWVLQRFGKKTSAFGIFAMVPFAILLAAVPTAPVAYVVAFVSGVSIAVSLLLPWSMLPDVVDDFQLQHRHGPGLETIFYSSYVFFTKLSGACALGISTLSLEFSGYKAGVCKQAEEVVVTLKVLIGAVPTCMILAGLCILMVGSTPKTPSRDASSRLSLRR

SEQ ID NO: 13609 - protein, 482 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 13610 - protein, 216 aa, Homo sapiens
MELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 13611 - protein, 418 aa, Homo sapiens
MHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 13612 - protein, 329 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIK

SEQ ID NO: 13613 - protein, 518 aa, Homo sapiens
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSASAPACYNLIPILTSGEVFGMHTEISITLFDNKQAEEHLKSLVVETQDLASPVLRSVSICTKVEEAFRQAHVIVVLDDSTNKEVFTLEDCLRSRVPLCRLYGYLIEKNAHESVRVIVGGRTFVNLKTVLLMRYAPRIAHNIIAVALGVEGEAKAILARKLKTAPSYIKDVIIWGNISGNNYVDLRKTRVYRYESAIWGPLHYSRPVLNLIFDSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAAEFPNQIPQTTFEKPQSLEFLNEFEGKTVES

SEQ ID NO: 13614 - protein, 283 aa, Homo sapiens
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSDTPRINTLHPSIQSSWHSVLTITIRKR

SEQ ID NO: 13615 - protein, 517 aa, Homo sapiens
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSASAPACYNLIPILTSGEVFGMHTEISITLFDNKQAEEHLKSLVVETQDLASPVLRSVSICTKVEEAFRQAHVIVVLDDSTNKEVFTLEDCLRSRVPLCRLYGYLIEKNAHESVRVIVGGRTFVNLKTVLLMRYAPRIAHNIIAVALGVEGEAKAILARKLKTAPSYIKDVIIWGNISGNNYVDLRKTRVYRYESAIWGPLHYSRPVLNLIFDSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAEFPNQIPQTTFEKPQSLEFLNEFEGKTVES

SEQ ID NO: 13616 - protein, 234 aa, Homo sapiens
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDGESENTPPPPLGLAASTLPPDAGTTAAAAESTNACDKLSTSTMSLPKPTEPPMNKRLSSSTVAISYSPDRDEK

SEQ ID NO: 13617 - protein, 773 aa, Homo sapiens
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRAHHMHLSPMEAILVSRLLTPTQSSLARSRASVMLSGQANDSVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 13618 - protein, 732 aa, Homo sapiens
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 13619 - protein, 687 aa, Homo sapiens
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 13620 - protein, 680 aa, Homo sapiens
MEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 13621 - protein, 617 aa, Homo sapiens
MMRRSLERTQQLELKKKYSWGAPLAIGPGGHDGLAASTLPPDAGTTAAAAESTNACDKLSTSTMSLPKPTEPPMNKRLSSSTVAISYSPDRAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 13622 - protein, 415 aa, Homo sapiens
MRGRDWPKKDEKKEKNVWLLGSNRSWRNRKEPGCSTKSKWRSDGENWKSSGSGRTKRELLWKRKGNSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 13623 - protein, 173 aa, Homo sapiens
MLPPPPRQPPPQARAARGAVRLQRPFLRSPLGVLRLLQLLAGAAFWITIATSKYQGPVHFALFVSVLFWLLTLGLYFLTLLGKHELVPVLGSRWLMVNVAHDVLAAALYGAATGIMSDQMQRHSYCNLKDYPLPCAYHAFLAAAVCGGVCHGLYLLSALYGCGRRCQGKQEVA

SEQ ID NO: 13624 - protein, 385 aa, Homo sapiens
MQTSSKPSDFLNLAKKKRKFSELLTTVVLLCLLTPSWTSTGRMWSHLNRLLFWSIFSSVTCRKAVLDCEAMKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVDPVTSPVLNIMVIQTETDRHITLHCLSVNGSLPINYTFFENHVAISPAISKYDREPAEFNLTKKNPGEEEEYRCEAKNRLPNYATYSHPVTMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNF

SEQ ID NO: 13625 - protein, 470 aa, Homo sapiens
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 13626 - protein, 107 aa, Homo sapiens
MAGEDVGAPPDHLWVHQEGIYRDEYQRTWVAVVEEETSFLRARVQQIQVPLGDAARPSHLLTSQLPLMWQLYPEERYMDNNSRLWQIQHHLMVRGVQELLLKLLPDD

SEQ ID NO: 13627 - protein, 1114 aa, Homo sapiens
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVCQRQLDHNLPLFKYLKGPSQRLIKYQMLLKGLLDFESPEDMEIDPGELGGSAKDGPKRTKDSAFSTELQQALAVIEDLIKSCELAVDLAAVTECPDDIGKLGKLLLHGPFSVWTIHKDRYKMKDLIRFKPSQRQIYLFERGIVFCKIRMEPGDQGLSPHYSFKKTMKLMTLSIRQLGRGSHRKFEIASRNGLEKYILQAASKEIRDCWFSEISKLLMEQQNNIKDQGNPQFEMSTSKGSGAGSGPWIKNMERATTSKEDPASSTGGIKGCSSREFSSMDTFEDCEGAEDMEKESSALSLAGLFQSDDSHETCSSKSAFLERGESSQGEKEERDEEETATRSTEEERAGASTGRLAPAGATAGFQARALRPRTSAQES

SEQ ID NO: 13628 - protein, 628 aa, Homo sapiens
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRYSSQYFK

SEQ ID NO: 13629 - protein, 172 aa, Homo sapiens [sequence omitted]

SEQ ID NO: 13630 - protein, 711 aa, Homo sapiens
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRVSLYSQ

SEQ ID NO: 13631 - protein, 1074 aa, Homo sapiens
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVCQRQLDHNLPLFKYLKGPSQRLIKYQMLLKGLLDFESPEDMEIDPGELGGSAKDGPKRTKDSAFSTELQQALAVIEDLIKSCELAVDLAAVTECPDDIGKLGKLLLHGPFSVWTIHKDRYKMKDLIRFKPSQRQIYLFERGIVFCKIRMEPGDQGLSPHYSFKKTMKLMTLSIRQLGRGSHRKFEIASRNGLEKYILQAASKEIRDCWFSEISKLLMEQQNNIKDQGNPQFEMSTSKGSGAGSGPWIKNMERATTSKEDPASSTGGIKGCSSREFSSMDTFEDCEGAEDMEKESSALSLAGLFQSDDSHETCSSKSAFLERGESSQGEKEERDEEET

SEQ ID NO: 13632 - protein, 119 aa, Homo sapiens
MEEPEMQLKGKKVTDKFTESVYVLANEPSVALYRLQEHVRRSLPELAQHKADMQRWEEQSQGAIYTVEYACSAVKNLVDSSVYFRSVEGLLKQAISIRDHMNASAQGHSPEEPPPPSSA

SEQ ID NO: 13633 - protein, 109 aa, Homo sapiens
MEEPEMQLKGKKVTDKFTESVYVLANEPSVALYRLQEHVRRSLPELAQHKADMQRWEEQSQGAIYTVEYACSAVKNLVDSSVYFRSVEGLLKQAISIRDHMNASAQGHR

SEQ ID NO: 13634 - protein, 238 aa, Homo sapiens
MLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLLQSMGHLADHSMAQTLQASLEGLPPSTSSGQPPLQDMLCLGGVAVSLSHIRN

SEQ ID NO: 13635 - protein, 607 aa, Homo sapiens
MCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLRETMVSAIRKFLEGIPDLQLVYTHHPLLLRFFLLYPELMSRYGHRVLELWFFWEESSYEELDDVTSAGQPALPASLVVLFQLLRSIPSILLILLDLIYSSPVDTAHKVLISLRTFLRRNEDIQVGGLIRGHFLLILQRLLVEHGASPSGVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 13636 - protein, 1274 aa, Homo sapiens
MAVRQAATAGTPGPRREEEAALLFERAHYRHDPRWLLPVTPRLCLACALELLPDPGVSLVRKKHMLSCFQDALVRHTSLVTQLVSQDQRVCIHFISVLFGLLCSMEDGSVTDLCIEVLIQITTQLKLEQTIRCLLDECHKELCNMPSMRGSLATLTLLGKLVDAIPALADELVMEHGNLMEHLLRGLVYPSEGIQASVCYLYGKLYSSPVAAEMLSGHFREKLFPLFLSILDGAQTKELQINCLGLLRQLLKYDLFVSMIMNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGIEAVVRSLQGSLKMNNIELHKQGLLLFAEILTRQPEEIKLFTSSAMCRDAGRALQEAVSSPVLEVAAEALKATSAFLRKDHQSTPPVQYGELQALLEAMLNRCAEFSQTLLSRRPLGHASSRDSEKAILQRGKFLLSTLEGFRSACRLAIEFQSEPSAQENPFTAPSAKKEDTLEAFSEFLLSACDSLCIPMVMRHLEQTTHPALMEVFLSILHNLFVIVPHMKEKFSKKLASSSFIRLTLELKARFCSGLSHSALNQVCSNFLYYMCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLRETMVSAIRKFLEGIPDLQLVYTHHPLLLRFFLLYPELMSRYGHRVLELWFFWEESSYEELDDVTSAGQPALPASLVVLFQLLRSIPSILLILLDLIYSSPVDTAHKVLISLRTFLRRNEDIQVGGLIRGHFLLILQRLLVEHGASPSGASGNLPLLLSLLSLMQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 13637 - protein, 384 aa, Homo sapiens
MGHPHQESSLFFTASGNLPLLLSLLSLMQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 13638 - protein, 506 aa, Homo sapiens
MNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGIEAVVRSLQGSLKMNNIELHKQGLLLFAEILTRQPEEIKLFTSSAMCRDAGRALQEAVSSPVLEVAAEALKATSAFLRKDHQSTPPVQYGELQALLEAMLNRCAEFSQTLLSRRPLGHASSRDSEKAILQRGKFLLSTLEGFRSACRLAIEFQSEPSAQENPFTAPSAKKEDTLEAFSEFLLSACDSLCIPMVMRHLEQTTHPALMEVFLSILHNLFVIVPHMKEKFSKKLASSSFIRLTLELKARFCSGLSHSALNQVCSNFLYYMCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLREQLHCSLISIS

SEQ ID NO: 13639 - protein, 269 aa, Homo sapiens
MEGAARQRQYCILLLFYLAYIHEDRFVSEAELFEAVQSFLLSLQDQGERPPLVVFKASIYLLAICQDKDNTLRETMVSAIRKFLEGIPDLQLVYTHHPLLLRFFLLYPELMSRYGHRVLELWFFWEESSYEELDDVTSAGQPALPASLVVLFQLLRSIPSILLILLDLIYSSPVDTAHKVLISLRTFLRRNEDIQVGGLIRGHFLLILQRLLVEHGASPSGVLLVLHSLGEPTIAAEPPLPDAAQECVRARTGQRGHEAPSPRCPGCLG

SEQ ID NO: 13640 - protein, 400 aa, Homo sapiens
MSKVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 13641 - protein, 318 aa, Homo sapiens
MLLGQKSQRYKAEEGLQAQGEAPGLMDVQIPTAEEQKAASSSSTLIMGTLEEVTDSGSPSPPQSPEGASSSLTVTDSTLWSQSDEGSSSNEEEGPSTSPDPAHLESLFREALDEKVAELVRFLLRKYQIKEPVTKAEMLESVIKNYKNHFPDIFSKASECMQVIFGIDVKEVDPAGHSYILVTCLGLSYDGLLGDDQSTPKTGLLIIVLGMILMEGSRAPEEAIWEALSVMGLYDGREHSVYWKLRKLLTQEWVQENYLEYRQAPGSDPVRYEFLWGPRALAETSYVKVLEHVVRVNARVRISYPSLHEEALGEEKGV

SEQ ID NO: 13642 - protein, 318 aa, Homo sapiens; identical to SEQ ID NO: 13641

SEQ ID NO: 13643 - protein, 318 aa, Homo sapiens; identical to SEQ ID NO: 13641

SEQ ID NO: 13644 - protein, 314 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 13645 - protein, 314 aa, Homo sapiens; identical to SEQ ID NO: 13644

SEQ ID NO: 13646 - protein, 33 aa, Homo sapiens
MPLEQRSQHCKPEEGLEARGEALGLVGAQAPAT

SEQ ID NO: 13647 - protein, 120 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFL

SEQ ID NO: 13648 - protein, 152 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFS

SEQ ID NO: 13649 - protein, 89 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSN

SEQ ID NO: 13650 - protein, 148 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFP

SEQ ID NO: 13651 - protein, 37 aa, Homo sapiens
MPLEQRSQHCKPEEGLEARGEALGLVGAQAPATEEQQ

SEQ ID NO: 13652 - protein, 343 aa, Homo sapiens
MPRGQKSKLRAREKRHQARCENQDLGATQATVAEGESPSPAYLLFGDRPQNLPAAETPSIPEALQGAPSTTNAIAPVSCSSNEGASSQDEKSLGSSREAEGWKEDPLNKKVVSLVHFLLQKYETKEPITKGDMIKFVIRKDKCHFNEILKRASEHMELALGVDLKEVDPIRHYYAFFSKLDLTYDETTSDEEKIPKTGLLMIALGVIFLNGNRAPEEAVWEIMNMMGVYADRKHFLYGDPRKVMTKDLVQLKYLEYQQVPNSDPPRYEFLWGPRAHAETSKMKVLEFVAKIHDTVPSAFPSCYEEALRDEEQRTQARAAARAHTAAMANARSRTTSSSFSHAK

SEQ ID NO: 13653 - protein, 778 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 13654 - protein, 778 aa, Homo sapiens; identical to SEQ ID NO: 13653

SEQ ID NO: 13655 - protein, 739 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQ

SEQ ID NO: 13656 - protein, 757 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKNPELREETPLSMAPSWYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 13657 - protein, 696 aa, Homo sapiens
MESEYVLCNWKDQLWPAKVLSRSETSSNSKRKKAFSLEVQILSLDEKIKLDSTETKILNKSQIEAIAASLGLQSEDSAPPTEETAYGRSLKVALGILNERTNLSQASTSDEEEITMLSQNVPQKQSDSPPHKKYRKDEGDLPGCLEERENSACLLASSESDDSLYDDKSQAPTMVDTIPSEVETKSLQNSSWCETFPSLSEDNDEKENKNKIDISAVMSVHSAVKEESACVKDEKFAPPLSPLSSDMLIMPKALKEESEDTCLETLAVPSECSAFSENIEDPGEGPSNPCLDTSQNQPSMESEMGAAACPGSCSRECEVSFSASNPVWDYSHLMSSERNFQRLDFEELEEEGQASDKSLLPSRINLSLLDDDEEDEELPRFILHYETHPFETGMIVWFKYQKYPFWPAVIKSIRRKERKASVLFVEANMNSEKKGIRVNFRRLKKFDCKEKQMLVDKAREDYSESIDWCISLICDYRVRIGCGSFTGSLLEYYAADISYPVRKETKQDTFRNKFPKLHNEDAREPMAVTSQTKKMSFQKILPDRMKAARDRANKNLVDFIVNAKGTENHLLAIVNGTKGSRWLKSFLNANRFTPCIETYFEDEDQLDEVVKYLQEVCNQIDQIMPTWIKDDKIKFILEVLLPEAIICSISAVDGLDYEAAEAKYLKGPCLGYRERELFDAKIIYEKRRKAPTNEAH

SEQ ID NO: 13658 - protein, 696 aa, Homo sapiens; identical to SEQ ID NO: 13657

SEQ ID NO: 13659 - protein, 696 aa, Homo sapiens; identical to SEQ ID NO: 13657

SEQ ID NO: 13660 - protein, 131 aa, Homo sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 13661 - protein, 741 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 13662 - protein, 1481 aa, Homo sapiens
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGDWDINNPSSSNVIYDEQSPLPPSSHFASIFEESHVPVIEESLRVQICEKAEELKDIVPEKKSTLNENQPEIKHQSLLQKNVSKRDPPSSHGHSNKKNLLKVENGVTRRGRSVSPKKPASQHSEEHLDKIPSPLKNNPKRRPRDQSLSPSKGENKSCQVSTRAGSGQDQCRKSRGRSASPKKQQKIEGSKAPSNAEAKLLEGKSRRIAGYTGSNAEQIPDGKEKSDVIRKDAKQNQLEKSRTRSPEKKIKRMVEKSLPSKMTNKTTSKEVSENEKGKKVTTGETSSSNDKIGENVQLSEKRLKQEPEEKVVSNKTEDHKGKELEAADKNKETGRFKPESSSPVKKTLITPGPWKVPSGNKVTGTIGMAEKRQ

SEQ ID NO: 13663 - protein, 1125 aa, Homo sapiens
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 13664 - protein, 1125 aa, Homo sapiens; identical to SEQ ID NO: 13663

SEQ ID NO: 13665 - protein, 409 aa, Homo sapiens
MGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGDWDINNPSSSNVIYDEQSPLPPSSHFASIFEESHVPVIEESLRVQICEKAEELKDIVPEKKSTLNENQPEIKHQSLLQKNVSKRDPPSSHGHSNKKNLLKVENGVTRRGRSVSPKKPASQHSEEHLDKIPSPLKNNPKRRPRDQSLSPSKGENKSCQVSTRAGSGQDQCRKSRGRSASPKKQQKIEGSKAPSNAEAKLLEGKSRRIAGYTGSNAEQIPDGKEKSDVIRKDAKQNQLEKAEQGLQRKKSKEWLRNLFHPK

SEQ ID NO: 13666 - protein, 399 aa, Homo sapiens
MGSSRCGPGAHPVHLWPPHFAFSGHHPRDLGPHSGPALLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 13667 - protein, 399 aa, Homo sapiens; identical to SEQ ID NO: 13666

SEQ ID NO: 13668 - protein, 399 aa, Homo sapiens; identical to SEQ ID NO: 13666

SEQ ID NO: 13669 - protein, 399 aa, Homo sapiens; identical to SEQ ID NO: 13666

SEQ ID NO: 13670 - protein, 399 aa, Homo sapiens; identical to SEQ ID NO: 13666

SEQ ID NO: 13671 - protein, 399 aa, Homo sapiens; identical to SEQ ID NO: 13666

SEQ ID NO: 13672 - protein, 399 aa, Homo sapiens; identical to SEQ ID NO: 13666

SEQ ID NO: 13673 - protein, 399 aa, Homo sapiens; identical to SEQ ID NO: 13666

SEQ ID NO: 13674 - protein, 399 aa, Homo sapiens; identical to SEQ ID NO: 13666

SEQ ID NO: 13675 - protein, 399 aa, Homo sapiens; identical to SEQ ID NO: 13666

SEQ ID NO: 13676 - protein, 399 aa, Homo sapiens; identical to SEQ ID NO: 13666

SEQ ID NO: 13677 - protein, 399 aa, Homo sapiens; identical to SEQ ID NO: 13666

SEQ ID NO: 13678 - protein, 291 aa, Homo sapiens
MSMPLHQISAIPSQDAISARVYRSKTKEKEREEQNEKTLGHFMSHSSNISKAGSPPSASAPAPVSSFSRTSITPSSQDICRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 13679 - protein, 362 aa, Homo sapiens
MASGSAGKPTGEAASPAPASAIGGASSQPRKRLVSVCDHCKGKMQLVADLLLLSSEARPVLFEGPASSGAGAESFEQCRDTIIARTKGLSILTHDVQSQLNMGRFGEAGDSLVELGDLVVSLTECSAHAAYLAAVATPGAQPAQPGLVDRYRVTRCRHEVEQGCAVLRATPLADMTPQLLLEVSQGLSRNLKFLTDACALASDKSRDRFSREQFKLGVKCMSTSASALLACVREVKVAPSELARSRCALFSGPLVQAVSALVGFATEPQFLGRAAAVSAEGKAVQTAILGGAMSVVSACVLLTQCLRDLAQHPDGGAKMSDHRERLRNSACAVSEGCTLLSQALRERSSPRTLPPVNSNSVN

SEQ ID NO: 13680 - protein, 292 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLLQYINQRKKFRRRWVGALASVTIPIHFIYGPLDPVNPYPEFLELYRKTLPRSTVSILDDHISHYPQLEDPMGFLNAYMGFINSF

SEQ ID NO: 13681 - protein, 326 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 13682 - protein, 292 aa, Homo sapiens; identical to SEQ ID NO: 13680

SEQ ID NO: 13683 - protein, 326 aa, Homo sapiens; identical to SEQ ID NO: 13681

SEQ ID NO: 13684 - protein, 266 aa, Homo sapiens
MRTEPLCGASPLLVPGDPYSVVVLLQGYAEPEGVGDAVRADGSVTLVLPQTRGPASSHRESPRGSGGAEAALEEAARGPILVDTGGPWAREALLGALAGQGVAPGDVTLVVGTHGHSDHIGNLGLFPGAALLVSHDFCLPGGRYLPHGLGEGQPLRLGPGLEVWATPGHGGQRDVSVVVAGTALGTVVVAGDVFERDGDEDSWQALSEDPAAQERSRKRVLVVADVVVPGHGPPFRVLREASQPETEGGGNSQQEPVVGDEEPALH

SEQ ID NO: 13685 - protein, 113 aa, Homo sapiens
MRTEPLCGASPLLVPGDPYSVVVLLQGYAEPEGVGDAVRADGSVTLVLPQTRGPASSHRESPRGSGGAEAALEEAARGPILVDTGGPWAREALLGALAGQGVAPGDVTLVVGT

SEQ ID NO: 13686 - protein, 279 aa, Homo sapiens
MSALEWYAHKSLGDGIFWIQERFYESGNRANIWLVRGSEQDVVIDTGLGLRSLPEYLYSSGLLQDREAKEDAARRPLLAVATHVHFDHSGGLYQFDRVAVHHAEAEALARGDNFETVTWLSDSEVVRTPSPGWRARQFRVQAVQPTLILQDGDVINLGDRQLTVMHMPGHSRGSICLHDKDRKILFSGDVVYDGSLIDWLPYSRISDYVGTCERLIELVDRGLVEKVLPGHFNTFGAERLFRLASNYISKAGICHKVSTFAMRSLASLALRVTNSRTSP

SEQ ID NO: 13687 - protein, 199 aa, Homo sapiens
MSALEWYAHKSLGDGIFWIQERFYESGNRANIWLVRGSEQDVVIDTGLGLRSLPEYLYSSGLLQDREAKEDAARRPLLAVATHVHFDHSGGLYQFDRVAVHHAEAEALARGDNFETVTWLSDSEVVRTPSPGWRARQFRVQAVQPTLILQDGNGPPRARALVKGGYWEETVRVPHVADLRGHKGDYFGTSQSHFCFTLP

SEQ ID NO: 13688 - protein, 209 aa, Homo sapiens
MAARRPLLAVATHVHFDHSGGLYQFDRVAVHHAEAEALARGDNFETVTWLSDSEVVRTPSPGWRARQFRVQAVQPTLILQDGDVINLGDRQLTVMHMPGHSRGSICLHDKDRKILFSGDVVYDGSLIDWLPYSRISDYVGTCERLIELVDRGLVEKVLPGHFNTFGAERLFRLASNYISKAGICHKVSTFAMRSLASLALRVTNSRTSP

SEQ ID NO: 13689 - protein, 279 aa, Homo sapiens; identical to SEQ ID NO: 13686

SEQ ID NO: 13690 - protein, 50 aa, Homo sapiens
SCTYASFCKCKEYKCTSCKKNCCSCYPVGCAKCAQGCICKGASDKCSCCA

SEQ ID NO: 13691 - protein, 40 aa, Homo sapiens
MDPNYSCTTGGSCTCAGSCKCKECKCTSCKKSCCFCCPMG

SEQ ID NO: 13692 - protein, 61 aa, Homo sapiens
MDPNCSCTTGVSCACTGSCTCKECKCTSCKKSCCSCCPVGCAKCAHGCVCKGTLENCSCCA

SEQ ID NO: 13693 - protein, 292 aa, Homo sapiens
METAEKECGALGGLFQAIVNDMKSSYPIWEDFNSKATKLHSQLRTTVLAAVAFLDAFQKVADMATNTRGATRDIGSALTRMCMRHRSIETKLRQFTNALLESLINPLQERIEDWKKAANQLDKDHAKEYKRARHEIKKKSSDTLKLQKKARKGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPPSVPSEPFVSFLSVRFWKNSPLLPAPSTPSSPI

SEQ ID NO: 13694 - protein, 747 aa, Homo sapiens
METAEKECGALGGLFQAIVNDMKSSYPIWEDFNSKATKLHSQLRTTVLAAVAFLDAFQKVADMATNTRGATRDIGSALTRMCMRHRSIETKLRQFTNALLESLINPLQERIEDWKKAANQLDKDHAKEYKRARHEIKKKSSDTLKLQKKARKELLGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPSSPSSSSSRKSSMCSAPSSSSSAKGGGAPWPGGAQTYSPSSTCRYRSLAQPATTTARLSSVSSHDSGFVSQDATYSKPPSPMPSDITSQKSSSSASSEASETCQSVSECSSPTSDWSKVGSHEQPSGATLQRRKDRVELLRDTEPGPASGGTLGPSGEEAPRPRMSPATIAAKHGEEVSPAASDLAMVLTRGLSLEHQKSSRDSLQYSSGYSTQTTTPSCSEDTIPSQGSDYDCYSVNGDADSEGPPEFDKSSTIPRNSNIAQNYRRLIQTKRPASTAGLPTAGLPTATGLPSGAPPGVATIRRTPSTKPTVRRALSSAGPIPIRPPIVPVKTPTVPDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 13695 - protein, 382 aa, Homo sapiens
MEPRAGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 13696 - protein, 383 aa, Homo sapiens
MEPRAVGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 13697 - protein, 383 aa, Homo sapiens
MEPRAVGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 13698 - protein, 381 aa, Homo sapiens
GPRLGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 13699 - protein, 220 aa, Homo sapiens
MMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 13700 - protein, 192 aa, Homo sapiens
MCSEPKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 13701 - protein, 195 aa, Homo sapiens
MLSATRRACQLLLLHSLFPVPRMGNSASNIVSPQEALPGRKEQTPVAAKHHVNGNRTVEPFPEGTQMAVFEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 13702 - protein, 169 aa, Homo sapiens
MAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 13703 - protein, 208 aa, Homo sapiens
MGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARRAEMLTGG

SEQ ID NO: 13704 - protein, 208 aa, Homo sapiens
MGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARRAEMLTVR

SEQ ID NO: 13705 - protein, 208 aa, Homo sapiens
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARQAEMLTCR

SEQ ID NO: 13706 - protein, 208 aa, Homo sapiens
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRIPLEPTPGRFPAVAGGPTPGMGCQLPPPLSGQLVTPADIRRQARRVKKARERLAKALQADRLARQAEMLTCR

SEQ ID NO: 13707 - protein, 208 aa, Homo sapiens
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRIPLEPTPGRFPAVAGGPTPGMGCQLPPPLSGQLVTPADIRRQARRVKKARERLAKALQADRLARQAEMLTGG

SEQ ID NO: 13708 - protein, 208 aa, Homo sapiens
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRIPLEPTPGRFPAVAGGPTPGMGCQLPPPLSGQLVTPADIRRQARRVKKARERLAKALQADRLARQAEMLTVR

SEQ ID NO: 13709 - protein, 204 aa, Homo sapiens
MGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARRAEM

SEQ ID NO: 13710 - protein, 991 aa, Homo sapiens
MRHRVCRGRSGQGRRRSSVIPWPVPKHVGWVVLLGCGGSGTSILVVSIVGSGLIKAMAPAEILNGKEISAQIRARLKNQVTQLKEQVPGFTPRLAILQVGNRDDSNLYINVKLKAAEEIGIKATHIKLPRTTTESEVMKYITSLNEDSTVHGFLVQLPLDSENSINTEEVINAIAPEKDVDGLTSINAGKLARGDLNDCFIPCTPKGCLELIKETGVPIAGRHAVVVGRSKIVGAPMHDLLLWNNATVTTCHSKTAHLDEEVNKGDILVVATGQPEMVKGEWIKPGAIVIDCGINYVPDDKKPNGRKVVGDVAYDEAKERASFITPVPGGVGPMTVAMLMQSTVESAKRFLEKFKPGKWMIQYNNLNLKTPVPSDIDISRSCKPKPIGKLAREIGLLSEEVELYGETKAKVLLSALERLKHRPDGKYVVVTGITPTPLGEGKSTTTIGLVQALGAHLYQNVFACVRQPSQGPTFGIKGGAAGGGYSQVIPMEEFNLHLTGDIHAITAANNLVAAAIDARIFHELTQTDKALFNRLVPSVNGVRRFSDIQIRRLKRLGIEKTDPTTLTDEEINRFARLDIDPETITWQRVLDTNDRFLRKITIGQAPTEKGHTRTAQFDISVASEIMAVLALTTSLEDMRERLGKMVVASSKKGEPVSAEDLGVSGALTVLMKDAIKPNLMQTLEGTPVFVHAGPFANIAHGNSSIIADRIALKLVGPEGFVVTEAGFGADIGMEKFFNIKCRYSGLCPHVVVLVATVRALKMHGGGPTVTAGLPLPKAYIQENLELVEKGFSNLKKQIENARMFGIPVVVAVNAFKTDTESELDLISRLSREHGAFDAVKCTHWAEGGKGALALAQAVQRAAQAPSSFQLLYDLKLPVEDKIRIIAQKIYGADDIELLPEAQHKAEVYTKQGFGNLPICMAKTHLSLSHNPEQKGVPTGFILPIRDIRASVGAGFLYPLVGTMSTMPGLPTRPCFYDIDLDPETEQVNGLF

SEQ ID NO: 13711 - protein, 935 aa, Homo sapiens [sequence omitted]

SEQ ID NO: 13712 - protein, 283 aa, Homo sapiens
MAHRGAHFAFRSRWQKTDDELCRHSMSFILHKAIRNDFFQSYLYLLEKIPLVKLYALTSQVINGEMQFYARAKLFYQEVPATEEGMMGNFIELSSPDIQASQKFLRKFVGGPGRAGTDCALDCGSGIGRVSKHVLLPVFNSVELVDMMESFLLEAQNYLQVKGDKVESYHCYSLQEFTPPFRRYDVIWIQWVSGHLTDKDLLAFLSRCRDGLKENGIIILKDNVAREGCILDLSDSSVTRDMDILRSLIRKSGLVVLGQEKQDGFPEQCIPVWMFALHSDRHS

SEQ ID NO: 13713 - protein, 396 aa, Homo sapiens
MKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 13714 - protein, 699 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 13715 - protein, 613 aa, Homo sapiens
MKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 13716 - protein, 543 aa, Homo sapiens
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 13717 - protein, 698 aa, Homo sapiens
MRAFVVSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 13718 - protein, 273 aa, Homo sapiens
MLRYPYFCRMYKECLSCWLESGIPNLGVWPNRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCSSMQLDTPERGFSLRKDGPLDMRMDGGRYPDMPTAADVVNALDQQALASILRTYGEEKHAKKIASAIVQARSIYPITRTQQLASIVAEYSETYFPVAQTLY

SEQ ID NO: 13719 - protein, 273 aa, Homo sapiens; identical to SEQ ID NO: 13718

SEQ ID NO: 13720 - protein, 99 aa, Homo sapiens
MLRYPYFCRMYKECLSCWLESGIPNLGVWPNRIHTTAEKYREYEAREQTDQTQAQELHRSQDRDFETMAKLHIPVMVDEVVHCLSPQKGQSLGVRSVGI

SEQ ID NO: 13721 - protein, 407 aa, Homo sapiens
MLRYPYFCRMYKECLSCWLESGIPNLGVWPNRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCSSMQLDTPERGFSLRKDGPLDMRMDGGRYPDMPTAADVVNALDQQALASILRTYGEEKHAKKIASAIVQARSIYPITRTQQLASIVAGAFPPSAIYTRKDLLQRSTHIATKTFQALRIFVNNELNELYTGLKTAQKFLRPGGRLVALSFHSLEDRIVKRFLLGISMTERFNLSVRQQVMKTSQLGSDHENTEEVSMRRAPLMWELIHKKVLSPQDQDVQDNPRGRSAKLRAAIKL

SEQ ID NO: 13722 - protein, 562 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCIYPLLGATLNGWYFLATEVDDMCFNYAKKNVEQNNLSDLIKVVKVPQKTLLMDALKEESEIIYDFCMCNPPFFANQLEAKGVNSRNPRRPPPSSVNTGGITEIMAEGGELEFVKRIIHDSLQLKKRLRWYSCMLGKKCSLAPLKEELRIQGVPKVTYTEFCQGRTMRWALAWSFYDDVTVPSPPSKRRKLEKPRKPITFVVLASVMKELSLKASPLRSETAEGIVVVTTWIEKILTDLKVQHKRVPCGKEEVSLFLTAIENSWIHLRRKKRERVRQLREVPRAPEDVIQALEEKKPTPKESGNSQELARGPQERTPCGPALREGEAAAVEGPCPSQESLSQEENPEPTEDERSEEKGGVEVLESCQGSSNGAQDQEASEQFGSPVAERGKRLPGVAGQYLFKCLINVKKEVDDALVEMHWVEGQNRDLMNQLCTYIRNQIFRLVAVN

SEQ ID NO: 13723 - protein, 224 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCIYPLLGATLNGWYFLATEVDDMCFNYAKKNVEQNNLSDLIKVVKVPQKTLLMDALKEESEIIYDFCMCNPPFFANQLEAKGVNSRNPRRPPPSSVNTGESLEPGRRRLQ

SEQ ID NO: 13724 - protein, 201 aa, Homo sapiens
MKELSLKASPLRSETAEGIVVVTTWIEKILTDLKVQHKRVPCGKEEVSLFLTAIENSWIHLRRKKRERVRQLREVPRAPEDVIQALEEKKPTPKESGNSQELARGPQERTPCGPALREGEAAAVEGPCPSQESLSQEENPEPTEDERSEEKGGVEVLESCQGSSNGAQDQEACWLKLAPQLWTASARSEGLFVESGLGSTA

SEQ ID NO: 13725 - protein, 344 aa, Homo sapiens
MAEGGELEFVKRIIHDSLQLKKRLRWYSCMLGKKCSLAPLKEELRIQGVPKVTYTEFCQGRTMRWALAWSFYDDVTVPSPPSKRRKLEKPRKPITFVVLASVMKELSLKASPLRSETAEGIVVVTTWIEKILTDLKVQHKRVPCGKEEVSLFLTAIENSWIHLRRKKRERVRQLREVPRAPEDVIQALEEKKPTPKESGNSQELARGPQERTPCGPALREGEAAAVEGPCPSQESLSQEENPEPTEDERSEEKGGVEVLESCQGSSNGAQDQEASEQFGSPVAERGKRLPGVAGQYLFKCLINVKKEVDDALVEMHWVEGQNRDLMNQLCTYIRNQIFRLVAVN

SEQ ID NO: 13726 - protein, 264 aa, Homo sapiens
MDVCLSSAQQPGRRGEGLSSPGGWLEAEKKGAPQKDSTGGVLEESNKIEPSLHSLQKFVPTDYASYTQEHYRFAGKEIVIQESIESYGAVVWPGAMALCQYLEEHAEELNFQDAKILEIGAGPGLVSIVASILGAQVTATDLPDVLGNLQYNLLKNTLQCTAHLPEVKELVWGEDLDKNFPKSAFYYDYVLASDVVYHHYFLDKLLTTMVYLSQPGTVLLWANKFRFSTDYEFLDKFKQVFDTTLLAEYPESSVKLFKGILKWD

SEQ ID NO: 13727 - protein, 162 aa, Homo sapiens
MWGRLLAAFPPVPTPQSTLFYRADVVVTDLEELQDLLKMNINMNKHLVTGSVQAKVLKWGEEIEGFPSPPDFILMADCIYYEESLEPLLKTLKDISGFETCIICCYEQRTMGKNPEIEKKYFELLQLDFDFEKIPLEKHDEEYRSEDIHIIYIRKKKSKFPS

SEQ ID NO: 13728 - protein, 194 aa, Homo sapiens
MADTLESSLEDPLRSFVRVLEKRDGTVLRLQQYSSGGVGCVVWDAAIVLSKYLETPEFSGDGAHALSRRSVLELGSGTGAVGLMAATLGADVVVTDLEELQDLLKMNINMNKHLVTGSVQAKVLKWGEEIEGFPSPPDFILMADCIYYEESLEPLLKTLKDISGFETCIICCYEQRTMGKNPEIEKKYFEKFPS

SEQ ID NO: 13729 - protein, 229 aa, Homo sapiens
MADTLESSLEDPLRSFVRVLEKRDGTVLRLQQYSSGGVGCVVWDAAIVLSKYLETPEFSGDGAHALSRRSVLELGSGTGAVGLMAATLGADVVVTDLEELQDLLKMNINMNKHLVTGSVQAKVLKWGEEIEGFPSPPDFILMADCIYYEESLEPLLKTLKDISGFETCIICCYEQRTMGKNPEIEKKYFELLQLDFDFEKIPLEKHDEEYRSEDIHIIYIRKKKSKFPS

SEQ ID NO: 13730 - protein, 205 aa, Homo sapiens
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIGVAGRPAPGRLHPVPTGPLPRMYSAGARGRHGAR

SEQ ID NO: 13731 - protein, 404 aa, Homo sapiens
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIEHTMATPLEDVGKQVWRGALLLADYILFRQDLFRGCTALELGAGTGLASIIAATMARTVYCTDVGADLLSMCQRNIALNSHLAATGGGIVRVKELDWLKDDLCTDPKVPFSWSQEEISDLYDHTTILFAAEVFYDDDLTDAVFKTLSRLAHRLKNACTAILSVEKRLNFTLRHLDVTCEAYDHFRSCLHALEQLADGKLRFVVEPVEASFPQLLVYERLQQLELWKIIAEPVT

SEQ ID NO: 13732 - protein, 378 aa, Homo sapiens
MAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTLPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 13733 - protein, 217 aa, Homo sapiens
MAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTLPVEENVTQKISDLEICADEFPGQPPTEYWRLAVVWETQSFQFYKRTMTQDSLFIAVIFLPQL

SEQ ID NO: 13734 - protein, 378 aa, Homo sapiens
MAGSYPEGAPAILADKRQQFGSRFLSDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAVVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 13735 - protein, 472 aa, Homo sapiens
MSVVHQLSAGWLLDHLSFINKINYQLHQHHEPCCRKKEFTTSVHFESLQMDSVSSSGVCAAFIASDSSTKPENDDGGNYEMFTRKFVFRPELFDVTKPYITPAVHKECQQSNEKEDLMNGVKKEISISIIGKKRKRCVVFNQGELDAMEYHTKIRELILDGSLQLIQEGLKSGFLYPLFEKQDKGSKPITLPLDACSLSELCEMAKHLPSLNEMEHQTLQLVEEDTSVTEQDLFLRVVENNSSFTKVITLMGQKYLLPPKSSFLLSDISCMQPLLNYRKTFDVIVIDPPWQNKSVKRSNRYSYLSPLQIQQIPIPKLAAPNCLLVTWVTNRQKHLRFIKEELYPSWSVEVVAEWHWVKITNSGEFVFPLDSPHKKPYEGLILGRVQEKTALPLRNADVNVLPIPDHKLIVSVPCTLHSHKPPLAEVLKDYIKPDGEYLELFARNLQPGWTSWGNEVLKFQHVDYFIAVESGS

SEQ ID NO: 13736 - protein, 472 aa, Homo sapiens; identical to SEQ ID NO: 13735

SEQ ID NO: 13737 - protein, 284 aa, Homo sapiens
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKVLKPGKSVLFRDYGLYDHAMLRFKASSKLGENFYVRQDGTRSYFFTDDFLAQLFMDTGYEEVVNEYVFRETVNKKEGLCVPRVFLQSKFLKPPKNPSPVVLGLDPKS

SEQ ID NO: 13738 - protein, 284 aa, Homo sapiens; identical to SEQ ID NO: 13737

SEQ ID NO: 13739 - protein, 244 aa, Homo sapiens
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVK

SEQ ID NO: 13740 - protein, 318 aa, Homo sapiens
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 13741 - protein, 317 aa, Homo sapiens
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGGKWEKPSEILEIKGQNWEEQVNSLPEVFRKAGFVIEAFTRLPYLCEGDMYNDYYVLDDAVFVLKPV

SEQ ID NO: 13742 - protein, 282 aa, Homo sapiens
MWTLRSPLTRSLYVKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 13743 - protein, 54 aa, Homo sapiens
MMKPQAETGEAARDPSLRPARTVLVGSLSWLRKQLQPTHCKYEGPRKARRLWFA

SEQ ID NO: 13744 - protein, 76 aa, Homo sapiens
MIAGEHRLDPATISLGVDQTDDHQQPTHSRIRKKRVSPTSVWFQPYFCILKTLCTTLDTVQDDATSSWMLICHVDF

SEQ ID NO: 13745 - protein, 2429 aa, Homo sapiens
MDMSDPNFWTVLSNFTLPHLRSGNRLRRTQSCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 13746 - protein, 2444 aa, Homo sapiens
MKAQRERLQIPGLTLDLTPRSLSPTPSSPGSPCSPLLAFHFWSCRTSNRKSLIGNGQSPALPRPHSPLSAHAGNSPQDSPRNFSPSASAHFSFARSLNRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 13747 - protein, 2434 aa, Homo sapiens
MDESSILRRRGLQKELSLPRRGSLIDSQKWNCLVKRCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 13748 - protein, 2626 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFCRTSNRKSLIGNGQSPALPRPHSPLSAHAGNSPQDSPRNFSPSASAHFSFARSLNRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 13749 - protein, 2444 aa, Homo sapiens
MKAQRERLQIPGLTLDLTPRSLSPTPSSPGSPCSPLLAFHFWSCRTSNRKSLIGNGQSPALPRPHSPLSAHAGNSPQDSPRNFSPSASAHFSFARRNDRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 13750 - protein, 250 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSLIDSQKWNCLVKRPVCPNAGRTSPLG

SEQ ID NO: 13751 - protein, 993 aa, Homo sapiens
MDMSDPNFWTVLSNFTLPHLRSGNRLRRTQSCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKS

SEQ ID NO: 13752 - protein, 168 aa, Homo sapiens
MDMSDPNFWTVLSNFTLPHLRSGNRLRRTQSCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSP

SEQ ID NO: 13753 - protein, 2623 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 13754 - protein, 383 aa, Homo sapiens
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13755 - protein, 412 aa, Homo sapiens
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13756 - protein, 441 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13757 - protein, 264 aa, Homo sapiens
TREAEGADGKTKIATPKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13758 - protein, 216 aa, Homo sapiens
MAEPRQEFEVMEDHAGTYGLGDRKDQREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13759 - protein, 383 aa, Homo sapiens; identical to SEQ ID NO: 13754

SEQ ID NO: 13760 - protein, 316 aa, Homo sapiens
MLRALQQRKREAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13761 - protein, 758 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPLLKGAGGKERPGSKEEVDEDRDVDESSPQDSPPSKASPAQDGRPPQTAAREATSIPGFPAEGAIPLPVDFLSKVSTEIPASEPNGPSAGRAKGQDAPLEFTFHVEITPNVQKEQAHSEEHLGRAAFPGAPGEGPEARGPSLGEDTKEADLPEPSEKQPAAAPRGKPVSWVPQLKARMVSKSKDGTGSDDKKAKTSTRSSAKTLKNRPCLSPKHPTPGSSDPLIQPSSPAVCPEPPSSPKYVSSVTPRTGSSGAKEMKLKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13762 - protein, 776 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPLLKGAGGKERPGSKEEVDEDRDVDESSPQDSPPSKASPAQDGRPPQTAAREATSIPGFPAEGAIPLPVDFLSKVSTEIPASEPNGPSAGRAKGQDAPLEFTFHVEITPNVQKEQAHSEEHLGRAAFPGAPGEGPEARGPSLGEDTKEADLPEPSEKQPAAAPRGKPVSWVPQLKARMVSKSKDGTGSDDKKAKTSTRSSAKTLKNRPCLSPKHPTPGSSDPLIQPSSPAVCPEPPSSPKYVSSVTPRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13763 - protein, 410 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 13764 - protein, 388 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPKRSWRLRPYLGYDWIAGSLDTSSSITSQPEAFFSKLQEFRETNKEECICSHPEPQLPGLRESSGSGVEEDHECVYCYRVNRRLFPVPVDPGTPCRLCRTPRDQQGPGTLAQPAHVRVSIPLSILEPPHRYHIHRRKSFDASDTLALPRHCLLGWDIFPPKSEKSSAPRNLDLWSSVSAEAQHQKLSGTSSPFHPASPMQMLPPTPTWSVPQVPRPHVPRQKP

SEQ ID NO: 13765 - protein, 358 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPKRSWRLRPYLGYDWIAGSLDTSSSITSQPEAFFSKLQEFRETNKEECICSHPEPQLPGLRESSGSGVEEDHECVYCYRVNRRLFPVPVDPGTPCRLCRTPRDQQGPGTLAQPAHVSTACWAGTFFLRSLRKAQPPGTWTSGPLSPLRPSTRSCPAPAALFTRPHQCRCCPRPRPGQCPRSLGPTSHGRSPED

SEQ ID NO: 13766 - protein, 689 aa, Homo sapiens
SSGLTVTAVKDSGEWNLEAGALVLADAGLCCIDEFNSLKEHDRTSIHEAMEQQTISVAKAGLVCKLNTRTTILAATNPKGQYDPQESVSVNIALGSPLLSRFDLILVLLDTKNEDWDRIISSFILENKGYPSKSEKLWSMEKMKTYFCLIRNLQPTLSDVGNQVLLRYYQMQRQSDCRNAARTTIRLLESLIRLAEAHARLMFRDTVTLEDAITVVSVMESSMQGGALLGGVNALHTSFPENPGEQYQRQCELILEKLELQSLLSEELRRLERLQNQSVHQSQPRVLEVETTPGSLRNGPGEESNFRTSSQQEINYSTHIFSPGGSPEGSPVLDPPPHLEPNRSTSRKHSAQHKNNRDDSLDWFDFMATHQSEPKNTVVVSPHPKTSGENMASKISNSTSQGKEKSEPGQRSKVDIGLLPSPGETGVPWRADNVESNKKKRLALDSEAAVSADKPDSVLTHHVPRNLQKLCKERAQKLCRNSTRVPAQCTVPSHPQSTPVHSPDRMLDSPKRKRPKSLAQVEEPAIENVKPPGSPVAKLAKFTFKQKSKLIHSFEDHSHVSPGATKIAVHSPKISQRRTRRDAALPVKRPGKLTSTPGNQISSQPQGETKEVSQQPPEKHGPREKVMCAPEKRIIQPELELGNETGCAHLTCEGDKKEEVSGSNKSGKVHACTLARLANFCFTPPSESK

SEQ ID NO: 13767 - protein, 391 aa, Homo sapiens
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVIKADFEQYYTFCRPSSCPSLESCDSSKFTCLSGLSSSPTRCRDYQEIKIQEQVQRLSVGSIPRSMKVILEDDLVDSCKSGDDLTIYGIVMQRWKPFQQDVRCEVEIVLKANYIQVNNEQSSGIIMDEEVQKEFEDFWEYYKSDPFAGRNVILASLCPQVFGMYLVKLAVAMVLAGGIQRTDATGTRVRGESHLLLVGDPGTGKSQFLKYAAKITPRSVLTTGIGSTSAGIVCDNFK

SEQ ID NO: 13768 - protein, 1143 aa, Homo sapiens
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVIKADFEQYYTFCRPSSCPSLESCDSSKFTCLSGLSSSPTRCRDYQEIKIQEQVQRLSVGSIPRSMKVILEDDLVDSCKSGDDLTIYGIVMQRWKPFQQDVRCEVEIVLKANYIQVNNEQSSGIIMDEEVQKEFEDFWEYYKSDPFAGRNVILASLCPQVFGMYLVKLAVAMVLAGGIQRTDATGTRVRGESHLLLVGDPGTGKSQFLKYAAKITPRSVLTTGIGSTSAGLTVTAVKDSGEWNLEAGALVLADAGLCCIDEFNSLKEHDRTSIHEAMEQQTISVAKAGLVCKLNTRTTILAATNPKGQYDPQESVSVNIALGSPLLSRFDLILVLLDTKNEDWDRIISSFILENKGYPSKSEKLWSMEKMKTYFCLIRNLQPTLSDVGNQVLLRYYQMQRQSDCRNAARTTIRLLESLIRLAEAHARLMFRDTVTLEDAITVVSVMESSMQGGALLGGVNALHTSFPENPGEQYQRQCELILEKLELQSLLSEELRRLERLQNQSVHQSQPRVLEVETTPGSLRNGPGEESNFRTSSQQEINYSTHIFSPGGSPEGSPVLDPPPHLEPNRSTSRKHSAQHKNNRDDSLDWFDFMATHQSEPKNTVVVSPHPKTSGENMASKISNSTSQGKEKSEPGQRSKVDIGLLPSPGETGVPWRADNVESNKKKRLALDSEAAVSADKPDSVLTHHVPRNLQKLCKERAQKLCRNSTRVPAQCTVPSHPQSTPVHSPDRMLDSPKRKRPKSLAQVEEPAIENVKPPGSPVAKLAKFTFKQKSKLIHSFEDHSHVSPGATKIAVHSPKISQRRTRRDAALPVKRPGKLTSTPGNQISSQPQGETKEVSQQPPEKHGPREKVMCAPEKRIIQPELELGNETGCAHLTCEGDKKEEVSGSNKSGKVHACTLARLANFCFTPPSESKSKSPPPERKNRGERGPSSPPTTTAPMRVSKRKSFQLRGSTEKLIVSKESLFTLPELGDEAFDCDWDEEMRKKS

SEQ ID NO: 13769 - protein, 156 aa, Homo sapiens
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVI

SEQ ID NO: 13770 - protein, 78 aa, Homo sapiens
MNSDQVTLVGQVFESYVSEYHKNDILLILKERDEDAHYPVVVNAMTLFETNMEIGEYFNMFPSEVLTIFDSALRRSAL

SEQ ID NO: 13771 - protein, 875 aa, Homo sapiens
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSKYTPDIVPMEKVKLSAGETETTLLVTKPLYELGQNDACLSLCWLPRDQKLLLAGMHRNLAIFDLRNTSQKMFVNTKAVQGVTVDPYFHDRVASFYEGQVAIWDLRKFEKPVLTLTEQPKPLTKVAWCPTRTGLLATLTRDSNIIRLYDMQHTPTPIGDETEPTIIERSVQPCDNYIASFAWHPTSQNRMIVVTPNRTMSDFTVFERISLAWSPITSLMWACGRHLYECTEEENDNSLEKDIATKMRLRALSRYGLDTEQVWRNHILAGNEDPQLKSLWYTLHFMKQYTEDMDQKSPGNKGSLVYAGIKSIVKSSLGMVESSRHNWSGLDKQSDIQNLNEERILALQLCGWIKKGTDVDVGPFLNSLVQEGEWERAAAVALFNLDIRRAIQILNEGASSEKGDLNLNVVAMALSGYTDEKNSLWREMCSTLRLQLNNPYLCVMFAFLTSETGSYDGVLYENKVAVRDRVAFACKFLSDTQLNRYIEKLTNEMKEAGNLEGILLTGLTKDGVDLMESYVDRTGDVQTASYCMLQGSPLDVLKDERVQYWIENYRNLLDAWRFWHKRAEFDIHRSKLDPSSKPLAQVFVSCNFCGKSISYSCSAVPHQGRGFSQYGVSGSPTKSKVTSCPGCRKPLPRCALCLINMGTPVSSCPGGTKSDEKVDLSKDKKLAQFNNWFTWCHNCRHGGHAGHMLSWFRDHAECPVSACTCKCMQLDTTGNLVPAETVQP

SEQ ID NO: 13772 - protein, 875 aa, Homo sapiens; identical to SEQ ID NO: 13771

SEQ ID NO: 13773 - protein, 64 aa, Homo sapiens
MSGTKPDILWAPHHVDRFVVCDSELSLYHVESTVNSELKAGSLRLSEDSAATLLSINSDTPYMK

SEQ ID NO: 13774 - protein, 150 aa, Homo sapiens
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSK

SEQ ID NO: 13775 - protein, 64 aa, Homo sapiens; identical to SEQ ID NO: 13773

SEQ ID NO: 13776 - protein, 179 aa, Homo sapiens
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSKYTPDIVPMEKVKLSAGETETTLLVTKPLY

SEQ ID NO: 13777 - protein, 262 aa, Homo sapiens [sequence omitted]

SEQ ID NO: 13778 - protein, 245 aa, Homo sapiens
MSDEFSLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHSYH

SEQ ID NO: 13779 - protein, 1391 aa, Homo sapiens
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 13780 - protein, 1347 aa, Homo sapiens
MPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRTTVAHCISVSQDYIFCGCADGTVRLFNPSNLHFLSTLPRPHALGTDIASVTEASRLFSGVANARYPDTIALTFDPTNQWLSCVYNDHSIYVWDVRDPKKVGKVYSALYHSSCVWSVEDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 13781 - protein, 1514 aa, Homo sapiens
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRNIDSFTTTVAHCISVSQDYIFCGCADGTVRLFNPSNLHFLSTLPRPHALGTDIASVTEASRLFSGVANARYPDTIALTFDPTNQWLSCVYNDHSIYVWDVRDPKKVGKVYSALYHSSCVWSVEVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 13782 - protein, 1508 aa, Homo sapiens
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRTTVAHCISVSQDYIFCGCADGTVRLFNPSNLHFLSTLPRPHALGTDIASVTEASRLFSGVANARYPDTIALTFDPTNQWLSCVYNDHSIYVWDVRDPKKVGKVYSALYHSSCVWSVEVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 13783 - protein, 156 aa, Homo sapiens
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQH

SEQ ID NO: 13784 - protein, 1231 aa, Homo sapiens
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRTTVAHCISVSQDYIFCGCADGTVRLFNPSNLHFLSTLPRPHALGTDIASVTEASRLFSGVANARYPDTIALTFDPTNQWLSCVYNDHSIYVWDVRDPKKVGKVYSALYHSSCVWSVEVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 13785 - protein, 894 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELPDSDGFLDSSEEIYYTARSNLDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 13786 - protein, 873 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 13787 - protein, 447 aa, Homo sapiens
MHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 13788 - protein, 159 aa, Homo sapiens
MQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSKNFQAAWI

SEQ ID NO: 13789 - protein, 482 aa, Homo sapiens
MFFLVTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAESWEEAASANAATVSIEMTPTNSLSRSPQRKKTESALYGCTVLLASVALGLDLRELHKAQAAEEPLPKEEKKKREGIFQRASKSRRSASPPTSLPSTCGEASSPPSLPLSSALGILSTPSFSTKCLLQMDSEDPLVDSAPVTCDSEMLTPDFCPTAPGSGREPALMPRLDTDCSVSRNLPSSFLQQTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDADVEGQSRDYTVPLCRMRSKTSRPSIYELEKEFLS

SEQ ID NO: 13790 - protein, 570 aa, Homo sapiens
MALRGAAGATDTPVSSAGGAPGGSASSSSTSSGGSASAGAGLWAALYDYEARGEDELSLRRGQLVEVLSQDAAVSGDEGWWAGQVQRRLGIFPANYVAPCRPAASPAPPPSRPSSPVHVAFERLELKELIGAGGFGQVYRATWQGQEVAVKAARQDPEQDAAAAAESVRREARLFAMLRHPNIIELRGVCLQQPHLCLVLEFARGGALNRALAAANAAPDPRAPGPRRARRIPPHVLVNWAVQIARGMLYLHEEAFVPILHRDLKSSNILLLEKIEHDDICNKTLKITDFGLAREWHRTTKMSTAGTYAWMAPEVIKSSLFSKGSDIWSYGVLLWELLTGEVPYRGIDGLAVAYGVAVNKLTLPIPSTCPEPFAKLMKECWQQDPHIRPSFALILEQLTAIEGAVMTEMPQESFHSMQDDWKLEIQQMFDELRTKEKELRSREEELTRAALQQKSQEELLKRREQQLAEREIDVLERELNILIFQLNQEKPKVKKRKGKFKRSRLKLKDGHRISLPSDFQHKITVQASPNLDKRRSLNSSSSSPPSSPTMMPRLRAIQCELSALPRGLLC

SEQ ID NO: 13791 - protein, 1036 aa, Homo sapiens
MALRGAAGATDTPVSSAGGAPGGSASSSSTSSGGSASAGAGLWAALYDYEARGEDELSLRRGQLVEVLSQDAAVSGDEGWWAGQVQRRLGIFPANYVAPCRPAASPAPPPSRPSSPVHVAFERLELKELIGAGGFGQVYRATWQGQEVAVKAARQDPEQDAAAAAESVRREARLFAMLRHPNIIELRGVCLQQPHLCLVLEFARGGALNRALAAANAAPDPRAPGPRRARRIPPHVLVNWAVQIARGMLYLHEEAFVPILHRDLKSSNILLLEKIEHDDICNKTLKITDFGLAREWHRTTKMSTAGTYAWMAPEVIKSSLFSKGSDIWSYGVLLWELLTGEVPYRGIDGLAVAYGVAVNKLTLPIPSTCPEPFAKLMKECWQQDPHIRPSFALILEQLTAIEGAVMTEMPQESFHSMQDDWKLEIQQMFDELRTKEKELRSREEELTRAALQQKSQEELLKRREQQLAEREIDVLERELNILIFQLNQEKPKVKKRKGKFKRSRLKLKDGHRISLPSDFQHKITVQASPNLDKRRSLNSSSSSPPSSPTMMPRLRAIQLTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAESWEEAASANAATVSIEMTPTNSLSRSPQRKKTESALYGCTVLLASVALGLDLRELHKAQAAEEPLPKEEKKKREGIFQRASKSRRSASPPTSLPSTCGEASSPPSLPLSSALGILSTPSFSTKCLLQMDSEDPLVDSAPVTCDSEMLTPDFCPTAPGSGREPALMPRLDTDCSVSRNLPSSFLQQTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDADVEGQSRDYTVPLCRMRSKTSRPSIYELEKEFLS

SEQ ID NO: 13792 - protein, 263 aa, Homo sapiens
MENLKHIITLGQVIHKRCEEMKYCKKQCRRLGHRVLGLIKPLEMLQDQGKRSVPSEKLTTAMNRFKAALEEANGEIEKFSNRSNICRFLTASQDKILFKDVNRKLSDVWKELSLLLQVEQRMPVSPISQGASWAQEDQQDADEDRRAFQMLRRDNEKIEASLRRLEINMKEIKETLRQSLESSSGKSPLEISRFKVKNVKTGSASGCNSEKIRKLVAVKRQQEPLGEDCPSELREIIDECRAHDPSVRPSVDEILKKLSTFSK

SEQ ID NO: 13793 - protein, 471 aa, Homo sapiens
MENLKHIITLGQVIHKRCEEMKYCKKQCRRLGHRVLGLIKPLEMLQDQGKRSVPSEKLTTAMNRFKAALEEANGEIEKFSNRSNICRFLTASQDKILFKDVNRKLSDVWKELSLLLQVEQRMPVSPISQGASWAQEDQQDADEDRRAFQMLRRDNEKIEASLRRLEINMKEIKETLRQYLPPKCMQEIPQEQIKEIKKEQLSGSPWILLRENEVSTLYKGEYHRAPVAIKVFKKLQAGSIAIVRQTFNKEIKTMKKFESPNILRIFGICIDETVTPPQFSIVMEYCELGTLRELLDREKDLTLGKRMVLVLGAARGLYRLHHSEAPELHGKIRSSNFLVTQGYQVKLAGFELRKTQTSMSLGTTREKTDRVKSTAYLSPQELEDVFYQYDVKSEIYSFGIVLWEIATGDIPFQGCNSEKIRKLVAVKRQQEPLGEDCPSELREIIDECRAHDPSVRPSVDEILKKLSTFSK

SEQ ID NO: 13794 - protein, 216 aa, Homo sapiens
MSFLFSSRSSKTFKPKKNIPEGSHQYELLKHAEATLGSGNLRQAVMLPEGEDLNEWIAVNTVDFFNQINMLYGTITEFCTEASCPVMSAGPRYEYHWADGTNIKKPIKCSAPKYIDYLMTWVQDQLDDETLFPSKIGVPFPKNFMSVAKTILKRLFRVYAHIYHQHFDSVMQLQEEAHLNTSFKHFIFFVQEFNLIDRRELAPLQELIEKLGSKDR

SEQ ID NO: 13795 - protein, 148 aa, Homo sapiens
MLFYLSSRSSKTFKPKKNIPEGSHQYELLKHAEATLGSGNLRQAVMLPEGEDLNEWIAVNTVDFFNQINMLYGTITEFCTEASCPVMSAGPRYEYHWADGTNIKKPIKCSAPKYIDYLMTWVQDQLDDETLFPSKIGELTLSKYSFFF

SEQ ID NO: 13796 - protein, 268 aa, Homo sapiens
MLGDHCSLPEDQARPGQSLQSGLCCKMVLQAVSKVLRKSKAKPNGKKPAAEERKAYLEPEHTKARITDFQFKELVVLPREIDLNEWLASNTTTFFHHINLQYSTISEFCTGETCQTMAVCNTQYYWYDERGKKVKCTAPQYVDFVMSSVQKLVTDEDVFPTKYGREFPSSFESLVRKICRHLFHVLAHIYWAHFKETLALELHGHLNTLYVHFILFAREFNLLDPKETAIMDDLTEVLCSGAGGVHSGGSGDGAGSGGPGAQNHVKER

SEQ ID NO: 13797 - protein, 217 aa, Homo sapiens
MSNPFLKQVFNKDKTFRPKRKFEPGTQRFELHKKAQASLNAGLDLRLAVQLPPGEDLNDWVAVHVVDFFNRVNLIYGTISDGCTEQSCPVMSGGPKYEYRWQDEHKFRKPTALSAPRYMDLLMDWIEAQINNEDLFPTNVGTPFPKNFLQTVRKILSRLFRVFVHVYIHHFDRIAQMGSEAHVNTCYKHFYYFVKEFGLIDTKELEPLKEMTARMCH

SEQ ID NO: 13798 - protein, 216 aa, Homo sapiens
MSIALKQVFNKDKTFRPKRKFEPGTQRFELHKRAQASLNSGVDLKAAVQLPSGEDQNDWVAVHVVDFFNRINLIYGTICEFCTERTCPVMSGGPKYEYRWQDDLKYKKPTALPAPQYMNLLMDWIEVQINNEEIFPTCVGVPFPKNFLQICKKILCRLFRVFVHVYIHHFDRVIVMGAEAHVNTCYKHFYYFVTEMNLIDRKELEPLKEMTSRMCH

SEQ ID NO: 13799 - protein, 268 aa, Homo sapiens
MKRRNLFALETGVPPWGLLWVRSRRVGMDEMTFHIWYPQVRAPGQQPQAQLAMALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 13800 - protein, 216 aa, Homo sapiens
MALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 13801 - protein, 239 aa, Homo sapiens
MPLSLAGYPQVRAPGQQPQAQLAMALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 13802 - protein, 652 aa, Homo sapiens
MHPGGGPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGVARDLQEEMLPGSSEDWLEPPGAVGRPATEPPREGTTEGDEEDATEAWRLHQKHVFVLSEAGKPVYSRYGSEEALSSTMGVMVALVSFLEADKNAIRSIHADGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 13803 - protein, 490 aa, Homo sapiens
MHPGGGPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPDGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 13804 - protein, 680 aa, Homo sapiens
MGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVPFKDFMQPPASRVQNGES

SEQ ID NO: 13805 - protein, 1676 aa, Homo sapiens
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEKVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQIQLFAPAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENACISLFGIPPYF

SEQ ID NO: 13806 - protein, 1717 aa, Homo sapiens
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQIQLFAPAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 13807 - protein, 1675 aa, Homo sapiens
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQIQLFAPAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENACISLFGIPPYF

SEQ ID NO: 13808 - protein, 900 aa, Homo sapiens
MLLYRGAPAGPGAPGCGLARPGGGPQAFGIRLSTMSPRYLQSNSSSHTRPFSAIAELLDNAVDPDVSARTVFIDVEEVKNKSCLTFTDDGCGMTPHKLHRMLSFGFTDKVIKKSQCPIGVFGNGFKSGSMRLGKDALVFTKNGGTLTVGLLSQTYLECVQAQAVIVPIVPFNQQNKKMIITEDSLPSLEAILNYSIFNRENDLLAQFDAIPGKKGTRVLIWNIRRNKNGKSELDFDTDQYDILVSDFDTEEKMTGGVTSELPETEYSLRAFCGILYMKPRMKIFLRQKKVTTQMIAKSLANVEYDTYKPTFTNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQGFGKAYAATYPRQLSPYFCPPSLGAS

SEQ ID NO: 13809 - protein, 937 aa, Homo sapiens
MLLYRGAPAGPGAPGCGLARPGGGPQAFGIRLSTMSPRYLQSNSSSHTRPFSAIAELLDNAVDPDVSARTVFIDVEEVKNKSCLTFTDDGCGMTPHKLHRMLSFGFTDKVIKKSQCPIGVFGNGFKSGSMRLGKDALVFTKNGGTLTVGLLSQTYLECVQAQAVIVPIVPFNQQNKKMIITEDSLPSLEAILNYSIFNRENDLLAQFDAIPGKKGTRVLIWNIRRNKNGKSELDFDTDQYDILVSDFDTEEKMTGGVTSELPETEYSLRAFCGILYMKPRMKIFLRQKKVTTQMIAKSLANVEYDTYKPTFTNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQVSYRTPEGDDLERALAKLTRLRIHVSYLLTSVLPHLELREIGYDSEQVDGILYTVLEANHILD

SEQ ID NO: 13810 - protein, 648 aa, Homo sapiens
MTGGVTSELPETEYSLRAFCGILYMKPRMKIFLRQKKVTTQMIAKSLANVEYDTYKPTFTNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQGFGKAYAATYPRQLSPYFCPPSLGAS

SEQ ID NO: 13811 - protein, 127 aa, Homo sapiens
MRPLDIDEVEAPEEVEVLEPEEDFEQFLLPVINEMREDIASLIREHGRAYLRTRSKLWEMDNMLIQIKTQVEASEESALNHVQHPSGEADERVSELCEKAEEKAKEIAKMAEMLVELVWRIERSESS

SEQ ID NO: 13812 - protein, 156 aa, Homo sapiens
MAAAGEGTPSSRGPRRDPPRRPPRNGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKL

SEQ ID NO: 13813 - protein, 350 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKSESGRVLQISAGVRYVQLSAYSEVNFFKVDRDNQETLIQTPFGFECIPYPVSSPAAGVPGPRAAKGGAEADVPLPRGDLELHLGALHGQEDTPGGLLGSSLF

SEQ ID NO: 13814 - protein, 497 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKSESGRVLQISAGVRYVQLSAYSEVNFFKVDRDNQETLIQTPFGFECIPYPVSSPAAGVPGPRAAKGGAEADVPLPRGDLELHLGALHGQEDTPGGLLARGHAPHCPGACQRVEQGCAEFTDVLLGPPPPGYHPFLFLDSLHKKAGGRSRGGLHPRGTPPTAQEPPGGSRPEGRATEEQAAAAHLGEYVLMIRDVTTPPFLGRRLPPAFKHLRVVAKRAGQPPHVLEEGPEASSSWQAAHSCTPEPPAPR

SEQ ID NO: 13815 - protein, 151 aa, Homo sapiens
TATTRLPLLRVDSVRVSPRNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKNGVSLLLSRLECSGAMSALRNLRLPRSSDSALAS

SEQ ID NO: 13816 - protein, 185 aa, Homo sapiens
VTGSCYLKMAVITKGRLWTERSREKAAGTGPGQETPSLDSLFWESLKATASWSTKPADVMKGRSPTACGKDTGFWWTGMDKCTRAPSMTTRGTALGRCSFRTVTSTTATGSGTGVRDTGCCAAPTAPPTSSDPPIYSRRNSRRHRLLPRHHELRVGEAPPGDLFSLSTAGVFSANRVSCLAASIP

SEQ ID NO: 13817 - protein, 79 aa, Homo sapiens
MNGFGRLEHFSGAVYEGQFKDNMFHGLGTYTFPNGAKYTGNFNENRVEGEGEYTDIQGLEWSGNFHFTAAPDLKLKLHM

SEQ ID NO: 13818 - protein, 79 aa, Homo sapiens; identical to SEQ ID NO: 13817

SEQ ID NO: 13819 - protein, 79 aa, Homo sapiens; identical to SEQ ID NO: 13817

SEQ ID NO: 13820 - protein, 240 aa, Homo sapiens
MPVSKCPKKSESLWKGWDRKAQRNGLRSQVYAVNGDYYVGEWKDNVKHGKGTQVWKKKGAIYEGDWKFGKRDGYGTLSLPDQQTGKCRRVYSGWWKGDKKSGYGIQFFGPKEYYEGDWCGSQRSGWGRMYYSNGDIYEGQWENDKPNGEGMLRLKNGNRYEGCWERGMKNGAGRFFHLDHGQLFEGFWVDNMAKCGTMIDFGRDEAPEPTQFPIPEVKILDPDGVLAEALAMFRKTEEGD

SEQ ID NO: 13821 - protein, 146 aa, Homo sapiens
MTLTKGSFTYSSGEEYRGEWKEGRRHGFGQLMFADGGTYLGHFENGLFNGFGVLTFSDGSRYEGEFAQGKFNGVGVFIRYDNMTFEGEFKNGRVDGFGLLTFPDGSHGIPRNEGLFENNKLLRREKCSAIVQRAQSASKSARNLTA

SEQ ID NO: 13822 - protein, 204 aa, Homo sapiens
MAWSRAGPMRSGVAPGCLGNSQWAAGIVPSAVAQDGGVKWGNRWWRWRRARWQPGAHQRKSPRRWNPASRRDGHPERPAPGRRHGFGQLMFADGGTYLGHFENGLFNGFGVLTFSDGSRYEGEFAQGKFNGVGVFIRYDNMTFEGEFKNGRVDGFGLLTFPDGSHGIPRNEGLFENNKLLRREKCSAIVQRAQSASKSARNLTA

SEQ ID NO: 13823 - protein, 146 aa, Homo sapiens; identical to SEQ ID NO: 13821

SEQ ID NO: 13824 - protein, 161 aa, Homo sapiens
MEYTGSKYIGEYVDGRMEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNADDDEHEWITRTCRKG

SEQ ID NO: 13825 - protein, 110 aa, Homo sapiens
MEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDG

SEQ ID NO: 13826 - protein, 175 aa, Homo sapiens
MEYTGSKYIGEYVDGRMEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNAGRFLPTLQHVFSSPTYEYVHLYVQMYAHT

SEQ ID NO: 13827 - protein, 471 aa, Homo sapiens
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEMLLVEFYKGSPDLVRLQEPWSQEHTYLDKLKISLASRTPKDQSLCHVLEQVCGVLKQGS

SEQ ID NO: 13828 - protein, 451 aa, Homo sapiens
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 13829 - protein, 344 aa, Homo sapiens
  MOD_RES (1)..(1): Any amino acid
XASMLPEQLYFLQSPPEEEPEYHPDASAQELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 13830 - protein, 190 aa, Homo sapiens
GSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 13831 - protein, 381 aa, Homo sapiens
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQYAYFRMGIKHPDIVKSEYLQYSLTKIKQRHIYLERLGRYQTPDKKGQTQIPNPLLKDILRVSEAEFLARTACTSVEEFQVFKKLLAREEEESESSTSDDKRASLDEDEDDDDEEDNDEDDNDEDDDDEDDDEAEDNDEDEDDDEEE

SEQ ID NO: 13832 - protein, 24 aa, Homo sapiens
MAPRGFSCLLLSTSEIDLPVKRRT

SEQ ID NO: 13833 - protein, 24 aa, Homo sapiens
MTTRGFSCLLLLIREIDLSAKRRI

SEQ ID NO: 13834 - protein, 24 aa, Homo sapiens
MATRRFSCLLLSTSEIDLSVKRRI

SEQ ID NO: 13835 - protein, 28 aa, Homo sapiens
MATQGFSCLLLSVSEIDLSMKRQYKQIR

SEQ ID NO: 13836 - protein, 24 aa, Homo sapiens
MATPGFSCLLLSTSEIDLPMKRRV

SEQ ID NO: 13837 - protein, 24 aa, Homo sapiens
MTPRGFSCLLLPTSETDLPVKRRT

SEQ ID NO: 13838 - protein, 24 aa, Homo sapiens
MATGGFGCLLLLIREIDLSVKRQI

SEQ ID NO: 13839 - protein, 24 aa, Homo sapiens
MAPRGFSCLLLSTSEIDLPVKRRA

SEQ ID NO: 13840 - protein, 24 aa, Homo sapiens
MARRGFSCLLLSTTATDLPVKRRT

SEQ ID NO: 13841 - protein, 1148 aa, Homo sapiens
MPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 13842 - protein, 249 aa, Homo sapiens
MNSQQTPVGTPKDKRVSNTPLRTVDGSPMMKAMYSVEITVEKDKVTGETRVLSSTTLLPRQPLPLGIKVYEDETKVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAETEAASREENQAGPEATTSDPQDLDMKKHRCKCCSIM

SEQ ID NO: 13843 - protein, 447 aa, Homo sapiens
TAAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPT

SEQ ID NO: 13844 - protein, 1773 aa, Homo sapiens
MRRGNISPAFWFLWLLLFGLLGPSSENTTAFTKGSDTTTASITGSETTMASTMASTSALTTGSKITTDSTTGSETTSASTMASTAAFTTGSETNTASTTDSGTTIASTRTFTTGSDTTTGSTAGSETIVASTTVSGTTTTFTIASTTVPETTMASSTTSTAGSEKTMASSIISETTMASTTGSETATVSTTGSETTTTSTASSEATKVSTTGSETTTASTAGSETTTTSTSMAGSEATTTSTADSKVITASSMSSETTVAPAAGSNTTTASTTGSETTTILIKASETTTASTAGSETTTPSPTGSQTTIVSISGSEITTTSTAGSENTTVSSAGSGTTTASMAGSETTVSTAGSETTTVSITGTETTMVSAMGSETTTNSTTSSETTVTSTAGSETTTVSTVGSETTTAYTADSETTAASTTGSEMTTVFTAGSETITPSTAGSETTTVSTAGSETTTVSTTGSETTTASTAHSETTAASTMGSETTKVSTAGSETTVSTAGSETTAASTEDSETNTAFTEDSKTTTASTTGFETTAASTTGSEPTMASTMGSETTMASTIGPETTKVSTASSEVTTVFAAGSETIRASTVGSETTTVSTTGSETTTASIMGSETSTDSTTGSETTTASTEGSETTTASTEGSEATTVSTTGSETTTVSITDSETTTTCTEGSEMTAVSTTVFETTTASTEGSEITIASTSDSETTTASTEGSETTTVTTAGSETKTAYTTGSETTTASNTGLETTTVFTIGSDTTTASTEGSETTAVSATGSEMTTVSTEGSENTTVSTTGSETTTVSTTGLETTTTSTEGSEMTTVSTTGAETTTDSTEGSGTTAASTAGSETTTVSTADSENTTASTADSETTSASTTGSETTTASTTSSETTTASTEGSETTTVSTTDSETTMVSTTGSERTITSTEGSETTTVSATGSETTVSTEGSGTTTVSITGSETTKVSTTGSETTTTSTEGSEITTASITGSETTTASTEGSETTTASTEGSETTSASTTGSETTTASTTSSETTMASIMGSETTMASTIGSETTKVSTASSKMTTVFTENSETTIASTTASETTTVSTAGSETIPASTAGSETTTTTSTEGSETTTASTEGSETTTASTESSETTTATTIGSETTTASTEGSETTTTSTEGSETTTASTEGSEITTVSTTGSETTTASTEGSETTTASTEGSELTTVSTTGSETITVSAEGSETTTVTTMGSETTTASTAGSETTTVSTAGSETTTASIEGSETTTVSSTGSETTTVSTTGTETTITSTEGSETTTVTTAGSETTAVYTTGSETTTTSTEGSETTTVSTTGSETTTASTADLETTTVSTSGSGTTTASTAGSETTTVYITGSKTTTASTEGSEATTVSTTSSETTTASTTGSEMTTVFTTVSETTTVSTIGSEATTSSAAGSEATTTSTEGSETTTASTAGSETTTASTAGSETTTASTSGSETNTACTTGSETSTPSSAGSETNTAFIIGSESTIASTASLEPTATSLTGSETTTVSITASGATAASTTVSSTTFVLTKATDVSIQPITNTPMSGTRTTGTRLTASSSVTMAPGMDFTASAASHTVPGIVLNTSGLGTSTMGASSTTSAHGVRTTTGSTREPTSSTFQETGPVSMGTNTVSMSHTPTNVIKPSGYLQPWAIILISLAAVVAAVGLSVGLSFCLRNLFFPLRYCGIYYPHGHSHSLGLDLNLGLGSGTFHSLGNALVHGGELEMGHGGTHGFGYGVGHGLSHIHGDGYGVNHGGHYGHGGGH

SEQ ID NO: 13845 - protein, 566 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 13846 - protein, 566 aa, Homo sapiens; identical to SEQ ID NO: 13845

SEQ ID NO: 13847 - protein, 566 aa, Homo sapiens; identical to SEQ ID NO: 13845

SEQ ID NO: 13848 - protein, 416 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSDSSTTSSGASTATNSDSSTTSSEASTATNSESSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 13849 - protein, 416 aa, Homo sapiens; identical to SEQ ID NO: 13848

SEQ ID NO: 13850 - protein, 416 aa, Homo sapiens; identical to SEQ ID NO: 13848

SEQ ID NO: 13851 - protein, 156 aa, Homo sapiens
TAQSLVLIDEFGKGTNTVDGLALLAAVLRHWLARGPTCPHIFVATNFLSLVQLQLLPQGPLVQYLVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 13852 - protein, 401 aa, Homo sapiens
MWPVLLFVFLSQTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYL

SEQ ID NO: 13853 - protein, 496 aa, Homo sapiens
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 13854 - protein, 728 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYL

SEQ ID NO: 13855 - protein, 194 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRR

SEQ ID NO: 13856 - protein, 333 aa, Homo sapiens
KILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVYLSPQVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLG

SEQ ID NO: 13857 - protein, 156 aa, Homo sapiens; identical to SEQ ID NO: 13851

SEQ ID NO: 13858 - protein, 727 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYL

SEQ ID NO: 13859 - protein, 508 aa, Homo sapiens
MWPVLLFVFLSQTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 13860 - protein, 135 aa, Homo sapiens
GYSRPRYSPQVLGVRIQNGRHPLMELCARTFVPNSTECGGDKGRVKVITGPNSSGKSIYLKQVAKAVNNATAQSLVLIDEFGKGTNTVDGLALLAAVLRHWLARGPTCPHIFVATNFLSLVQLQLLPQGPLVQYL

SEQ ID NO: 13861 - protein, 497 aa, Homo sapiens
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 13862 - protein, 194 aa, Homo sapiens; identical to SEQ ID NO: 13855

SEQ ID NO: 13863 - protein, 467 aa, Homo sapiens
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 13864 - protein, 65 aa, Homo sapiens
TAQSLVLIDEFGKGTNTVDGLALLAAVLRHWLARGPTCPHIFVATNFLSLVQLQLLPQGPLVQYL

SEQ ID NO: 13865 - protein, 115 aa, Homo sapiens
IAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMVRPSTSVR

SEQ ID NO: 13866 - protein, 496 aa, Homo sapiens; identical to SEQ ID NO: 13853

SEQ ID NO: 13867 - protein, 158 aa, Homo sapiens
HESLKLLQRVLDEINPQSVVTSAKQDENMTRFLGKLASQEHREPKRPEIIFLPSVDFGLEISKQRLLSGNYSFIPDAMTATEKILFLSSIIPFDCLLTIPSQVRALGGLLKFLGRRRIGVELEDYNVSVPILGFKKFMLTHLVNIDQDTYRNPQQMPL

SEQ ID NO: 13868 - protein, 158 aa, Homo sapiens
TVYSALGLRDACRSLPQSIQLFRDIAQEFSDDLHHIASLIGKVYLSPQVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLG

SEQ ID NO: 13869 - protein, 745 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYL

SEQ ID NO: 13870 - protein, 727 aa, Homo sapiens; identical to SEQ ID NO: 13858

SEQ ID NO: 13871 - protein, 466 aa, Homo sapiens
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 13872 - protein, 254 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYRLECNGAISAQCNLCLLGSSDSPASAS

SEQ ID NO: 13873 - protein, 263 aa, Homo sapiens
HYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLDWPRVSGQEGGD

SEQ ID NO: 13874 - protein, 159 aa, Homo sapiens
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQVFFQERKRSLELSIILSGTW

SEQ ID NO: 13875 - protein, 307 aa, Homo sapiens
MGSTMEPPGGAYLHLGAVTSPVGTARVLQLAFGCTTFSLVAHRGGFAGVQGTFCMAAWGFCFAVSALVVACEFTRLHGCLRLSWGNFTAAFAMLATLLCATAAVLYPLYFARRECSPEPAGCAARDFRLAASVFAGLLFLAYAVEVALTRARPGQVSSYMATVSGLLKIVQAFVACIIFGALVHDSRYGRYVATQWCVAVYSLCFLATVAVVALSVMGHTGGLGCPFDRLVVVYTFLAVLLYLSAAVIWPVFCFDPKYGEPKRPPNCARGSCPWDSQLVVAIFTYVNLLLYVVDLAYSQRIRFVPSL

SEQ ID NO: 13876 - protein, 307 aa, Homo sapiens; identical to SEQ ID NO: 13875

SEQ ID NO: 13877 - protein, 252 aa, Homo sapiens
MWRAPEAALRPEVSLERRGPEMKPAVDEMFPEGAGPYVDLDEVARARRESPSAGGSTGLLMDLAANEKAVHADFFNDFEDLFDDDDIHSSGLPRTSQQSSMVPALQRGQSEHGVRGKAAERPVVSEERCELNGREVAALDRAFGSTGHGQGAEALMFTRCREHPLCGTNKATSEGKMGTGRLRNSLRKNQSKWLGSYLEVLRTTRSRREVSEDSTISVSTHWRGKCFKSDETPSVAGGEEGKKTTQPCIDVR

SEQ ID NO: 13878 - protein, 78 aa, Homo sapiens
MWRAPEAALRPEVSLERRGPEMKPAVDEMFPEGAGPYVDLDEAGGSTGLLMDLAANEKAVHADFFNDFEDLFDDDDIQ

SEQ ID NO: 13879 - protein, 1214 aa, Homo sapiens
MTLPHSLGGAGDPRPPQAMEVHRLEHRQEEEQKEERQHSLRMGSSVRRRTFRSSEEEHEFSAADYALAAALALTASSELSWEAQLRRQTSAVELEERGQKRVGFGNDWERTEIAFLQTHRLLRQRRDWKTLRRRTEEKVQEAKELRELCYGRGPWFWIPLRSHAVWEHTTVLLTCTVQASPPPQVTWYKNDTRIDPRLFRAGKYRITNNYGLLSLEIRRCAIEDSATYTVRVKNAHGQASSFAKVLVRTYLGKDAGFDSEIFKRSTFGPSVEFTSVLKPVFAREKEPFSLSCLFSEDVLDAESIQWFRDGSLLRSSRRRKILYTDRQASLKVSCTYKEDEGLYMVRVPSPFGPREQSTYVLVRDAEAENPGAPGSPLNVRCLDVNRDCLILTWAPPSDTRGNPITAYTIERCQGESGEWIACHEAPGGTCRCPIQGLVEGQSYRFRVRAISRVGSSVPSKASELVVMGDHDAARRKTEIPFDLGNKITISTDAFEDTVTIPSPPTNVHASEIREAYVVLAWEEPSPRDRAPLTYSLEKSVIGSGTWEAISSESPVRSPRFAVLDLEKKKSYVFRVRAMNQYGLSDPSEPSEPIALRGPPATLPPPAQVQAFRDTQTSVSLTWDPVKDPELLGYYIYSRKVGTSEWQTVNNKPIQGTRFTVPGLRTGKEYEFCVRSVSEAGVGESSAATEPIRVKQALATPSAPYGFALLNCGKNEMVIGWKPPKRRGGGKILGYFLDQHDSEELDWHAVNQQPIPTRVCKVSDLHEGHFYEFRARAANWAGVGELSAPSSLFECKEWTMPQPGPPYDVRASEVRATSLVLQWEPPLYMGAGPVTGYHVSFQEEGSEQWKPVTPGPISGTHLRVSDLQPGKSYVFQVQAMNSAGLGQPSMPTDPVLLEDKPGAHEIEVGVDEEGFIYLAFEAPEAPDSSEFQWSKDYKGPLDPQRVKIEDKVNKSKVILKEPGLEDLGTYSVIVTDADEDISASHTLTEEELEKLKKLSHEIRNPVIKLISGWNIDILERGEVRLWLEVEKLSPAAELHLIFNNKEIFSSPNRKINFDREKGLVEVIIQNLSEEDKGSYTAQLQDGKAKNQITLTLVDDDFDKLLRKADAKRRDWKRKQGPYFERPLQWKVTEDCQVQLTCKASVTNTKKETRFQWFFQRAEMPDGQYDPETGTGLLCIEEASVAPASGLTFSFGCKPGRAKSSGLGVRAGPRLG

SEQ ID NO: 13880 - protein, 1440 aa, Homo sapiens
MTLPHSLGGAGDPRPPQAMEVHRLEHRQEEEQKEERQHSLRMGSSVRRRTFRSSSEEEHEFSAADYALAAALALTASSELSWEAQLRRQTSAVELEERGQKRVGFGNDWERTEIAFLQTHRLLRQRRDWKTLRRRTEEKVQEAKELRELCYGRGPWFWIPLRSHAVWEHTTVLLTCTVQASPPPQVTWYKNDTRIDPRLFRAGKYRITNNYGLLSLEIRRCAIEDSATYTVRVKNAHGQASSFAKVLVRTYLGKDAGFDSEIFKRSTFGPSVEFTSVLKPVFAREKEPFSLSCLFSEDVLDAESIQWFRDGSLLRSSRRRKILYTDRQASLKVSCTYKEDEGLYMVRVPSPFGPREQSTYVLVRDAEAENPGAPGSPLNVRCLDVNRDCLILTWAPPSDTRGNPITAYTIERCQGESGEWIACHEAPGGTCRCPIQGLVEGQSYRFRVRAISRVGSSVPSKASELVVMGDHDAARRKTEIPFDLGNKITISTDAFEDTVTIPSPPTNVHASEIREAYVVLAWEEPSPRDRAPLTYSLEKSVIGSGTWEAISSESPVRSPRFAVLDLEKKKSYVFRVRAMNQYGLSDPSEPSEPIALRGPPATLPPPAQVQAFRDTQTSVSLTWDPVKDPELLGYYIYSRKVGTSEWQTVNNKPIQGTRFTVPGLRTGKEYEFCVRSVSEAGVGESSAATEPIRVKQALATPSAPYGFALLNCGKNEMVIGWKPPKRRGGGKILGYFLDQHDSEELDWHAVNQQPIPTRVCKVSDLHEGHFYEFRARAANWAGVGELSAPSSLFECKEWTMPQPGPPYDVRASEVRATSLVLQWEPPLYMGAGPVTGYHVSFQEEGSEQWKPVTPGPISGTHLRVSDLQPGKSYVFQVQAMNSAGLGQPSMPTDPVLLEDKPGAHEIEVGVDEEGFIYLAFEAPEAPDSSEFQWSKDYKGPLDPQRVKIEDKVNKSKVILKEPGLEDLGTYSVIVTDADEDISASHTLTEEELEKLKKLSHEIRNPVIKLISGWNIDILERGEVRLWLEVEKLSPAAELHLIFNNKEIFSSPNRKINFDREKGLVEVIIQNLSEEDKGSYTAQLQDGKAKNQITLTLVDDDFDKLLRKADAKRRDWKRKQGTGPYFERPLQWKVTEDCQVQLTCKVTNTKKETRFQWFFQRAEMPDGQYDPETGTGLLCIEELSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKTLAIIEKNRAKVVRGLPDVATIMEDKTLCLTCIVSGDPTPEISWLKNDQPVTFLDRYRMEVRGTEVTITIEKVNSEDSGRYGVFVKNKYGSETGQVTISVFKHGDEPKELKSM

SEQ ID NO: 13881 - protein, 330 aa, Homo sapiens
MDISKKNRVRQGSRGRGKTISKNSESRGQQRRHMVTNTKKETRFQWFFQRAEMPDGQYDPETGTGLLCIEELSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKTLAIIEKNRAKVVRGLPDVATIMEDKTLCLTCIVSGDPTPEISWLKNDQPVTFLDRYRMEVRGTEVTITIEKVNSEDSGRYGVFVKNKYGSETGQVTISVFKHGDEPKELKSM

SEQ ID NO: 13882 - protein, 1437 aa, Homo sapiens
MTLPHSLGGAGDPRPPQAMEVHRLEHRQEEEQKEERQHSLRMGSSVRRRTFRSSEEEHEFSAADYALAAALALTASSELSWEAQLRRQTSAVELEERGQKRVGFGNDWERTEIAFLQTHRLLRQRRDWKTLRRRTEEKVQEAKELRELCYGRGPWFWIPLRSHAVWEHTTVLLTCTVQASPPPQVTWYKNDTRIDPRLFRAGKYRITNNYGLLSLEIRRCAIEDSATYTVRVKNAHGQASSFAKVLVRTYLGKDAGFDSEIFKRSTFGPSVEFTSVLKPVFAREKEPFSLSCLFSEDVLDAESIQWFRDGSLLRSSRRRKILYTDRQASLKVSCTYKEDEGLYMVRVPSPFGPREQSTYVLVRDAEAENPGAPGSPLNVRCLDVNRDCLILTWAPPSDTRGNPITAYTIERCQGESGEWIACHEAPGGTCRCPIQGLVEGQSYRFRVRAISRVGSSVPSKASELVVMGDHDAARRKTEIPFDLGNKITISTDAFEDTVTIPSPPTNVHASEIREAYVVLAWEEPSPRDRAPLTYSLEKSVIGSGTWEAISSESPVRSPRFAVLDLEKKKSYVFRVRAMNQYGLSDPSEPSEPIALRGPPATLPPPAQVQAFRDTQTSVSLTWDPVKDPELLGYYIYSRKVGTSEWQTVNNKPIQGTRFTVPGLRTGKEYEFCVRSVSEAGVGESSAATEPIRVKQALATPSAPYGFALLNCGKNEMVIGWKPPKRRGGGKILGYFLDQHDSEELDWHAVNQQPIPTRVCKVSDLHEGHFYEFRARAANWAGVGELSAPSSLFECKEWTMPQPGPPYDVRASEVRATSLVLQWEPPLYMGAGPVTGYHVSFQEEGSEQWKPVTPGPISGTHLRVSDLQPGKSYVFQVQAMNSAGLGQPSMPTDPVLLEDKPGAHEIEVGVDEEGFIYLAFEAPEAPDSSEFQWSKDYKGPLDPQRVKIEDKVNKSKVILKEPGLEDLGTYSVIVTDADEDISASHTLTEEELEKLKKLSHEIRNPVIKLISGWNIDILERGEVRLWLEVEKLSPAAELHLIFNNKEIFSSPNRKINFDREKGLVEVIIQNLSEEDKGSYTAQLQDGKAKNQITLTLVDDDFDKLLRKADAKRRDWKRKQGPYFERPLQWKVTEDCQVQLTCKVTNTKKETRFQWFFQRAEMPDGQYDPETGTGLLCIEELSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKTLAIIEKNRAKVVRGLPDVATIMEDKTLCLTCIVSGDPTPEISWLKNDQPVTFLDRYRMEVRGTEVTITIEKVNSEDSGRYGVFVKNKYGSETGQVTISVFKHGDEPKELKSM

SEQ ID NO: 13883 - protein, 331 aa, Homo sapiens
MDISKKNRVRQGSRGRGKTISKNSESRGQQRRHMVTNTKKETRFQWFFQRAEMPDGQYDPETGTGLLCIEEASLSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKFLYISQYRAKVVRGLPDVATIMEDKTLCLTCIVSGDPTPEISWLKNDQPVTFLDRYRMEVRGTEVTITIEKVNSEDSGRYGVFVKNKYGSETGQVTISVFKHGDEPKELKSM

SEQ ID NO: 13884 - protein, 354 aa, Homo sapiens
MEAATAPEVAAGSKLKVKEASPADAEPPQASPGQGAGSPTPQLLPPIEEHPKIWLPRALRQTYIRKVGDTVNLLIPFQGKPKPQAIWTHDGCALDTRRVSVRNGEQDSILFIREAQRADSGRYQLRVQLGGLEATATIDILVIERPGPPQSIKLVDVWGFSATLEWTPPQDTGNTALLGYTVQKADTKSGLWFTVLEHYHRTSCIVSDLIIGNSYAFRVFAENQCGLSETAPITTDLAHIQKAATVYKTKGFAQRDFSEAPKFTQPLADCTTVTGYNTQLFCCVRASPRPKIIWLKNKMDIQGNPKYRALTHLGICSLEIRKPGPFDGGIYTCKAVNPLGEASVDCRVDVKVPN

SEQ ID NO: 13885 - protein, 487 aa, Homo sapiens
MQEFARRYFRRSQALLGQTDGGAAGKDTDSLVQYTKAPIQESLLSLSDDVSKLAVASFLALMRFMGDQSKPRGKDEMDLLYELLKLCQQEKLRDEIYCQVIKQVTGHPRPEHCTRGWSFLSLLTGFFPPSTRLMPYLTKFLQDSGPSQELARSSQEHLQRTVKYGGRRRMPPPGEMKAFLKGQAIRLLLIHLPGGVDYRTNIQTFTVAAEVQEELCRQMGITEPQEVQEFALFLIKEKSQLVRPLQPAEYLNSVVVDQDVSLHSRRLHWETPLHFDNSTYISTHYSQVLWDYLQGKLPVSAKADAQLARLAALQHLSKANRNTPSGQDLLAYVPKQLQRQVNTASIKNLMGQELRRLEGHSPQEAQISFIEAMSQLPLFGYTVYGVLRVSMQALSGPTLLGLNRQHLILMDPSSQSLYCRIALKSLQRLHLLSPLEEKGPPGLEVNYGSADNPQTIWFELPQAQELLYTTVFLIDSSASCTEWPSIN

SEQ ID NO: 13886 - protein, 665 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 13887 - protein, 272 aa, Homo sapiens
MISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTVWLL

SEQ ID NO: 13888 - protein, 456 aa, Homo sapiens
MPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTDKKLYKTRLFSFTSLKFLVTIH

SEQ ID NO: 13889 - protein, 218 aa, Homo sapiens
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKQTKLMEFPQEMEEEEEEEVMELVVAAARKLHSLKLTRIGTEKSRGQVLPGGEFVLLTRVT

SEQ ID NO: 13890 - protein, 777 aa, Homo sapiens
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKKSYSSTLRGMPSALKNGIISDQELLPRRNSLILKPKPDPAQQTDSQNSDTEQYFREWFSKPANLHGVILPRVSGTHIKLWKLCYFRWVPEAQISLGGSITAFHKLSLLADEVDVLSRMLRQQRSGPLEACYGELGQSRMYFNASGPHHTDTSGTPEFLSSSFPFSPVGNLCRRSILGTPLSKFLSGAKIWLSTETLANED

SEQ ID NO: 13891 - protein, 272 aa, Homo sapiens
MWWGGRGQSFNIAPQKEEPEMGSVQENRMPEPRSRQPSSCLASRCLPGEQILAWAPGVRKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATRLRCFSSSLIVSGSSSSSFQLILNSLSFSFLLFMTVSGFLTPLPS

SEQ ID NO: 13892 - protein, 640 aa, Homo sapiens
MPPRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQERGDRDLNGLLSSLVQLLSAPEARTLFGFQSLVQREWVAAGHPFLTRLGGTGASEEAPVFLLFLDCVWQLLQQFPADFEFSEFFLLALHDSVRVPDTLTFLRNTPWERGKQSGQLNSYTQVYTPGYSQPPAGNSFNLQLSVWDWDLRYSNAQILQFQNPGYDPEHCPDSWLPRPQPSFMVPGPPSSVWLFSRGALTPLNQLCPWRDSPSLLAVSSRWLPRPAISSESLADQEWGLPSHWGACPLPPGLLLPGYLGPQIRLWRRCYLRGRPEVQMGLSAPTISGLQDELSHLQELLRKWTPRISPEDHSKKRDPHTILNPTEIAGILKGQSHPFWITRC

SEQ ID NO: 13893 - protein, 254 aa, Homo sapiens
MAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQAAFSPRSPNTVWLPITSTARVGGSWTSLPDSAWGNWGQ

SEQ ID NO: 13894 - protein, 354 aa, Homo sapiens
MPEPRSRQPSSCLASRCLPGEQILAWAPGVRKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQGSGVSPLP

SEQ ID NO: 13895 - protein, 709 aa, Homo sapiens
MWWGGRGQSFNIAPQKEEPEMGSVQENRMPEPRSRQPSSCLASRCLPGEQILAWAPGVRKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQERGDRDLNGLLSSLVQLLSAPEARTLFGFQSLVQREWVAAGHPFLTRLGGTGASEEAPVFLLFLDCVWQLLQQFPADFEFSEFFLLALHDSVRVPDTLTFLRNTPWERGKQSGQLNSYTQVYTPGYSQPPAGNSFNLQLSVWDWDLRYSNAQILQFQNPGYDPEHCPDSWLPRPQPSFMVPGPPSSVWLFSRGALTPLNQLCPWRDSPSLLAVSSRWLPRPAISSESLADQEWGLPSHWGACPLPPGLLLPGYLGPQIRLWRRCYLRGRPEVQMGLSAPTISGLQDELSHLQELLRKWTPRISPEDHSKKRDPHTILNPTEIAGILKGRAEGDLG

SEQ ID NO: 13896 - protein, 220 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKRISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 13897 - protein, 235 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 13898 - protein, 237 aa, Homo sapiens
MGRKSSKAKEKKQKRLEERAAMDAVCAKVDAANRLGDPLEAFPVFKKYDRNGLNVSIECKRVSGLEPATVDWAFDLTKTNMQTMYEQSEWGWKDREKREEMTDDRAWYLIAWENSSVPVAFSHFRFDVECGDEVLYCYEVQLESKVRRKGLGKFLIQILQLMANSTQMKKVMLTVFKHNHGAYQFFREALQFEIDDSSPSMSGCCGEDCSYEILSRRTKFGDSHHSHAGGHCGGCCH

SEQ ID NO: 13899 - protein, 197 aa, Homo sapiens
MPFVPKWTLPTGLNVSIECKRVSGLEPATVDWAFDLTKTNMQTMYEQSEWGWKDREKREEMTDDRAWYLIAWENSSVPVAFSHFRFDVECGDEVLYCYEVQLESKVRRKGLGKFLIQILQLMANSTQMKKVMLTVFKHNHGAYQFFREALQFEIDDSSPSMSGCCGEDCSYEILSRRTKFGDSHHSHAGGHCGGCCH

SEQ ID NO: 13900 - protein, 214 aa, Homo sapiens
MSDLEDDETPQLSAHALAALQEFYAEQKQQIEPGEDDKYNIGIIEENWQLSQFWYSQETALQLAQEAIAAVGEGGRIACVSAPSVYQKLRELCRENFSIYIFEYDKRFAMYGEEFIFYDYNNPLDLPERIAAHSFDIVIADPPYLSEECLRKTSETVKYLTRGKILLCTGAIMEEQAAELLGVKMCTFVPRHTRNLANEFRCYVNYDSGLDCGI

SEQ ID NO: 13901 - protein, 214 aa, Homo sapiens; identical to SEQ ID NO: 13900

SEQ ID NO: 13902 - protein, 369 aa, Homo sapiens
MKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVIALESVNVIDAGETVLVEGLRVAPWERGKGVAGLLQRFCSQLVKRQHPGVKVARLTRDDQLGPRELKKYRLITKQGILLVRFNASALLAGLGARLAALRTSGTFSPLPTEAVSEAGGDVARLLLSPSVQRDVLPGGTIIQDWQPYRPSESNLRLLAAKGLEWRVDSRARPRVLTLCTRPFPIPHGGDGTWRYLNIDAFGSDGAQVQSQLLWHLQRQAPRLVGLNVMCQLFLEPQLWSQLADFCQVGLGLELVKGYTEQYLLEADI

SEQ ID NO: 13903 - protein, 156 aa, Homo sapiens
MKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVIALESVNVIDAGETVLVEGLRVAPWERGKGVAGLLQRFCSQLVKRQHPGVKV

SEQ ID NO: 13904 - protein, 369 aa, Homo sapiens; identical to SEQ ID NO: 13902

SEQ ID NO: 13905 - protein, 286 aa, Homo sapiens
MELILSTSPAELTLDPACQPKLPLDSTCQPEMTFNPGPTELTLDPEHQPEETPAPSLAELTLEPVHRRPELLDACADLINDQWPRSRTSRLHSLGQSSDAFPLCLMLLSPHPTLEAAPVVVGHARLSRVLNQPQSLLVETVVVARALRGRGFGRRLMEGLEVFARARGFRKLHLTTHDQVHFYTHLGYQLGEPVQGLVFTSRRLPATLLNAFPTAPSPRPPRKAPNLTAQAAPRGPKGPPLPPPPPLPECLTISPPVPSGPPSKSLLETQYQNVRGRPIFWMEKDI

SEQ ID NO: 13906 - protein, 286 aa, Homo sapiens; identical to SEQ ID NO: 13905

SEQ ID NO: 13907 - protein, 207 aa, Homo sapiens
MRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 13908 - protein, 1429 aa, Homo sapiens
MDSQFHMAGEASQSWLKAKEKQRGTSYMVAVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWSLSEQGTLLDILEGVGAPVSLLARGGALVASASPQSSSFKVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQDLESESAQGNETKSNKCSQVCLIV

SEQ ID NO: 13909 - protein, 1432 aa, Homo sapiens
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWSLSEQGTLLDILEGVGAPVSLLARGGALVASASPQSSSFKVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTAPC

SEQ ID NO: 13910 - protein, 1429 aa, Homo sapiens; identical to SEQ ID NO: 13908

SEQ ID NO: 13911 - protein, 1358 aa, Homo sapiens
MVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWSLSEQGTLLDILEGVGAPVSLLARGGALVASASPQSSSFKVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQDLESESAQGNETKSNKCSQVCLIV

SEQ ID NO: 13912 - protein, 1432 aa, Homo sapiens; identical to SEQ ID NO: 13909

SEQ ID NO: 13913 - protein, 393 aa, Homo sapiens
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNDDENF

SEQ ID NO: 13914 - protein, 160 aa, Homo sapiens
MVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 13915 - protein, 165 aa, Homo sapiens
MRQHRQFMDRTHYLLTFSSSETLLRLLLRIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 13916 - protein, 160 aa, Homo sapiens; identical to SEQ ID NO: 13914

SEQ ID NO: 13917 - protein, 373 aa, Homo sapiens
MEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 13918 - protein, 373 aa, Homo sapiens; identical to SEQ ID NO: 13917

SEQ ID NO: 13919 - protein, 87 aa, Homo sapiens
MAGASLGARFYRQIKRHPGIIPMIGLICLGMGSAALYLLRLALRSPDVCWDRKNNPEPWNRLSPNDQYKFLAVSTDYKKLKKDRPDF

SEQ ID NO: 13920 - protein, 87 aa, Homo sapiens; identical to SEQ ID NO: 13919

SEQ ID NO: 13921 - protein, 128 aa, Homo sapiens
MTGYTPDEKLRLQQLRELRRRWLKDQELSPREPVLPPQKMGPMEKFWNKFLENKSPWRKMVHGVYKKSIFVFTHVLVPVWIIHYYMKYHVSEKPYGIVEKKSRIFPGDTILETGEVIPPMKEFPDQHH

SEQ ID NO: 13922 - protein, 250 aa, Homo sapiens
MDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCPYSPAGHGSTYFWHSFENYFPVGPLLSY

SEQ ID NO: 13923 - protein, 359 aa, Homo sapiens
MDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCPYSPAGGIILNIKWLEGVFYAALNICTARNMAHSQVLQLLSELFLSVHFEDCGKDTASCPKLQLTDFVSKAYGKNLSQERPFPWFDLTAVQLKETPFSQHLSSSPVLQDHLTHLYCASFGISLTKEQPVISTGFPSQ

SEQ ID NO: 13924 - protein, 223 aa, Homo sapiens
MDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCP

SEQ ID NO: 13925 - protein, 232 aa, Homo sapiens
MDLPIQDSHDSSTSPKGKQPTTAEKSATKKEDKVPVKKQKTRTVFSSTQLCVLNDRFQRQKYLSLQQMQELSNILNLSYKQVKTWFQNQRMKSKRWQKNNWLKNSNGVTQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFNTPQTMDLFLNYSMNMQPEDV

SEQ ID NO: 13926 - protein, 303 aa, Homo sapiens
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDTWGTYLLTTETGLQKDHALWDHTAQNLLRMGLAFLVLVALVWFLVEDWLSRKRTRERASRASTWEGRRRLNTQTL

SEQ ID NO: 13927 - protein, 303 aa, Homo sapiens; identical to SEQ ID NO: 13926

SEQ ID NO: 13928 - protein, 303 aa, Homo sapiens; identical to SEQ ID NO: 13926

SEQ ID NO: 13929 - protein, 303 aa, Homo sapiens; identical to SEQ ID NO: 13926

SEQ ID NO: 13930 - protein, 303 aa, Homo sapiens; identical to SEQ ID NO: 13926

SEQ ID NO: 13931 - protein, 303 aa, Homo sapiens; identical to SEQ ID NO: 13926

SEQ ID NO: 13932 - protein, 303 aa, Homo sapiens; identical to SEQ ID NO: 13926

SEQ ID NO: 13933 - protein, 303 aa, Homo sapiens; identical to SEQ ID NO: 13926

SEQ ID NO: 13934 - protein, 1909 aa, Homo sapiens
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRQSSQNWDKRLSIDSSLPSGFASPTNELPPTRIKESHILEGLRKLQKRKVLLEPPSVITKWGYKDCMNSNEGIYSPGIKSSSLKEYPPCKTADLGSPCKEPHKTFVYDLDSHVDADDDPSTLALLQAVPNQSCRPHGSKLTHSVSDSLFGWETNRKHFLEGTSSVYPKERPEKLTSCASSCPLEMKLCPSVQTPQVQRERGPQGQGHGRMALNLQLSDTDDNETFDELHIESSDEKSPSDVSLAADTDKSVENLDVLVGFGKSLCGSPEEEEKQVPIPSETRPKTFSFIKQQRVVKRTSSEECVTVIFDAEDGEPIEFSSHQTGVVTVTRNEISINSTPAGPKAEHTELLPQGIACLQPRAAARDYTFFKRSEEDTEKNIPKDNVDNVPRVSTESFSSRTVTQNPQQQKLVKPTHNISCQSNSRSSAPMGIYQKQNLTKIPPRGKSSPQKSKLMEPEATTLLPSSGLVTLEKSPALAPGKLSRFMKTESSGPLFELRSDPHIPKHSAQLPHSSRMPSRRDWVQCPKSQTPGSRSRPAIESSDSGEPPTRDEHCGSGPEAGVKSPSPPPPPGRSVSLLARPSYDYSPAPSSTKSETRVPSETARTPFKSPLLKGISAPVISSNPATTEVQRKKPSVAFKKPIFTHPMPSPEAVIQTRCPAHAPSSSFTVMALGPPKVSPKRGVPKTSPRQTLGTPQRDIGLQTPRISPSTHEPLEMTSSKSVSPGRKGQLNDSASTPPKPSFLGVNESPSSQVSSSSSSSSPAKSHNSPHGCQSAHEKGLKTRLPVGLKVLMKSPQLLRKSSTVPGKHEKDSLNEASKSSVAVNKSKPEDSKNPASMEITAGERNVTLPDSQAQGSLADGLPLETALQEPLESSIPGSDGRDGVDNRSMRRSLSSSKPHLKPALGMNGAKARSHSFSTHSGDKPSTPPIEGSGKVRTQIITNTAERGNSLTRQNSSTESSPNKAPSAPMLESLPSVGRPSGHPSSGKGSLGSSGSFSSQHGSPSKLPLRIPPKSEGLLIPPGKEDQQAFTQGECPSANVAVLGEPGSDRRSCPPTPTDCPEALQSPGRTQHPSTFETSSTSKLETSGRHPDASATATDAVSSEAPLSPTIEEKVMLCIQENVEKGQVQTKPTSVEAKQKPGPSFASWFGFRKSRLPALSSRKMDISKTKVEKKDAKVLGFGNRQLKSERKKEKKKPELQCETENELIKDTKSADNPDGGLQSKNNRRTPQDIYNQLKIEPRNRHSPVACSTKDTFMTELLNRVDKKAAPQTESGSSNASCRNVLKGSSQGSCLIGSSISTQGNHKKNMKIKADMEVPKDSLVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 13935 - protein, 69 aa, Homo sapiens
MEGKRQLEKRDFGKRLSLDSSLVEYMDSNKYIEHLLTQLEEQHRSLWREKLAVARLQREVAQRTSEGAM

SEQ ID NO: 13936 - protein, 590 aa, Homo sapiens
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 13937 - protein, 590 aa, Homo sapiens; identical to SEQ ID NO: 13936

SEQ ID NO: 13938 - protein, 1909 aa, Homo sapiens; identical to SEQ ID NO: 13934

SEQ ID NO: 13939 - protein, 590 aa, Homo sapiens
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEMPIT

SEQ ID NO: 13940 - protein, 178 aa, Homo sapiens
MDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALERNGWNWHPVS

SEQ ID NO: 13941 - protein, 1334 aa, Homo sapiens
MSEAMDQPAGGPGNPRPGEGDDGSMEPGTCQELLHRLRELEAENSALAQANENQRETYERCLDEVANHVVQALLNQKDLREECIKLKKRVFDLERQNQMLSALFQQKLQLTTGSLPQIPLTPLQPPSEPPASPSLSSTEGPAAPLPLGHCAGQREVCWEQQLRPGGPGPPAAPPPALDALSPFLRKKAQILEVLRALEETDPLLLCSPATPWRPPGQGPGSPEPINGELCGPPQPEPSPWAPCLLLGPGNLGGLLHWERLLGGLGGEEDTGRPWGPSRGPPQAQGTSSGPNCAPGSSSSSSSDEAGDPNEAPSPDTLLGALARRQLNLGQLLEDTESYLQAFLAGAAGPLNGDHPGPGQSSSPDQAPPQLSKSKGLPKSAWGGGTPEAHRPGFGATSEGQGPLPFLSMFMGAGDAPLGSRPGHPHSSSQVKSKLQIGPPSPGEAQGPLLPSPARGLKFLKLPPTSEKSPSPGGPQLSPQLPRNSRIPCRNSGSDGSPSPLLARRGLGGGELSPEGAQGLPTSPSPCYTTPDSTQLRPPQSALSTTLSPGPVVSPCYENILDLSRSTFRGPSPEPPPSPLQVPTYPQLTLEVPQAPEVLRSPGVPPSPCLPESYPYGSPQEKSLDKAGSESPHPGRRTPGNSSKKPSQGSGRRPGDPGSTPLRDRLAALGKLKTGPEGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKVELAKSRLAGALCPQVPRTPAKVPTSAPSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARPRPGGPAPGPNTGLGQVQGQLAGMYQGADTFMQQLLNRVDGKELPSKSWREPKPEYGDFQPVSSDPKSPWPACGPRNGLVGPLQGCGKPPGKPSSEPGRREEMPSEDSLAEPVPTSHFTACGSLTRTLDSGIGTFPPPDHGSSGTPSKNLPKTKPPRLDPPPGVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMALPVDRKRSQEPSRPSPTPQGPPFGGSRTPSTSDMAEEGRVASGGPPGLETSESLSDSLYDSLSSCGSQG

SEQ ID NO: 13942 - protein, 1308 aa, Homo sapiens
MDQPAGGPGNPRPGEGDDGSMEPGTCQELLHRLRELEAENSALAQANENQRETYERCLDEVANHVVQALLNQKDLREECIKLKKRVFDLERQNQMLSALFQQKLQLTTGSLPQIPLTPLQPPSEPPASPSLSSTEGPAAPLPLGHCAGQREVCWEQQLRPGGPGPPAAPPPALDALSPFLRKKAQILEVLRALEETDPLLLCSPATPWRPPGQGPGSPEPINGELCGPPQPEPSPWAPCLLLGPGNLGGLLHWERLLGGLGGEEDTGRPWGPSRGPPQAQGTSSGPNCAPGSSSSSSSDEAGDPNEAPSPDTLLGALARRQLNLGQLLEDTESYLQAFLAGAAGPLNGDHPGPGQSSSPDQAPPQLSKSKGLPKSAWGGGTPEAHRPGFGATSEGQGPLPFLSMFMGAGDAPLGSRPGHPHSSSQVKSKLQIGPPSPGEAQGPLLPSPARGLKFLKLPPTSEKSPSPGGPQLSPQLPRNSRIPCRNSGSDGSPSPLLARRGLGGGELSPEGAQGLPTSPSPCYTTPDSTQLRPPQSALSTTLSPGPVVSPCYENILDLSRSTFRGPSPEPPPSPLQVPTYPQLTLEVPQAPEVLRSPGVPPSPCLPESYPYGSPQEKSLDKAGSESPHPGRRTPGNSSKKPSQGSGRRPGDPGSTPLRDRLAALGKLKTGPEGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKVPTSAPSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARPRPGGPAPGPNTGLGQVQGQLAGMYQGADTFMQQLLNRVDGKELPSKSWREPKPEYGDFQPVSSDPKSPWPACGPRNGLVGPLQGCGKPPGKPSSEPGRREEMPSEDSLAEPVPTSHFTACGSLTRTLDSGIGTFPPPDHGSSGTPSKNLPKTKPPRLDPPPGVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMALPVDRKRSQEPSRPSPTPQGPPFGGSRTPSTSDMAEEGRVASGGPPGLETSESLSDSLYDSLSSCGSQG

SEQ ID NO: 13943 - protein, 371 aa, Homo sapiens
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 13944 - protein, 369 aa, Homo sapiens
MPECWDGVGEGNAGAVKLAGLGDPRWSPGHLLSPGHQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 13945 - protein, 371 aa, Homo sapiens; identical to SEQ ID NO: 13943

SEQ ID NO: 13946 - protein, 391 aa, Homo sapiens
MKVLGHRLELLTGLLLHDVTMAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 13947 - protein, 297 aa, Homo sapiens
MQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYIAYLKDRRLSGGAVPSASMTRLARSRTASLTSASSVDGSRPQACTHSESSEGLGQVNHTMEVSC

SEQ ID NO: 13948 - protein, 339 aa, Homo sapiens
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 13949 - protein, 352 aa, Homo sapiens
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYIAYLKDRRLSGGAVPSASMTRLARSRTASLTSASSVDGSRPQACTHSESSEGLGQVNHTMEVSC

SEQ ID NO: 13950 - protein, 114 aa, Homo sapiens
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDVYCCGAERRG

SEQ ID NO: 13951 - protein, 243 aa, Homo sapiens
MEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMALENNYEVIFREPDTRWKFNVQELARRNIHGVSREKIHRMKERYEHDVTFHSVLHAEKPSRMNRNQDRNNALPSNNARYWNSYTEFPNRRAHGGFTNESSYHRRGGCHHGY

SEQ ID NO: 13952 - protein, 137 aa, Homo sapiens
MRNGISPIIIDNTNLHAWEMKPYAVMALENNYEVIFREPDTRWKFNVQELARRNIHGVSREKIHRMKERYEHDVTFHSVLHAEKPSRMNRNQDRNNALPSNNARYWNSYTEFPNRRAHGGFTNESSYHRRGGCHHGY

SEQ ID NO: 13953 - protein, 173 aa, Homo sapiens
MEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMVFQTEQKNLFRLEMDMVVFRPEMKKHSWCLKRKNPPNERTV

SEQ ID NO: 13954 - protein, 583 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 13955 - protein, 737 aa, Homo sapiens
MALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 13956 - protein, 752 aa, Homo sapiens
MSYGEIEEFCLVRIVMALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 13957 - protein, 170 aa, Homo sapiens
MLIKVKTLTGKEIEIDIEPTDKVERIKERVEEKEGIPPQQQRLIYSGKQIDGTVRDRRGQDVRLYPEVPEVLKRLQSLGVPGAAASRTSEIEGANQLLELFDLFRYFVHREIYPGSKITHFERLQQKTGIPFSQMIFFDDERRNIVDVSKLGVTCIHIQNGMNLQTLSQG

SEQ ID NO: 13958 - protein, 112 aa, Homo sapiens
MWKGGRSHPFLPCSSRRAGSGGQLDSILPHQSPAWGPWGCKDLSSGVPSFLTSSILWKSAVFAEDNGLKIHLCSYKRDDLVLFYDCTSFVLTFGPSPWFLTQGFLNPLEFSA

SEQ ID NO: 13959 - protein, 858 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 13960 - protein, 726 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 13961 - protein, 761 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 13962 - protein, 555 aa, Homo sapiens
MGNTVHRTLPDPSPPARLLATRPCCGPGPERRPVLGEAPRFHAQAKGKNVRLDGHSRRATRRNSFCNGVTFTQRPIRLYEQVRLRLVAVRPGWSGALRFGFTAHDPSLMSAQDIPKYACPDLVTRPGYWAKALPENLALRDTVLAYWADRHGRVFYSVNDGEPVLFHCGVAVGGPLWALIDVYGITDEVQLLESAFADTLTPARLSQARFSACLPPSSHDAANFDNNELENNQVVAKLGHLALGRAPGPPPADAAAAAIPCGPRERPRPASSPALLEADLRFHATRGPDVSLSADRKVACAPRPDGGRTLVFSERPLRPGESLFVEVGRPGLAAPGALAFGITSCDPGVLRPNELPADPDALLDRKEYWVVARAGPVPSGGDALSFTLRPGGDVLLGINGRPRGRLLCVDTTQALWAFFAVRGGVAGQLRLLGTLQSSPATTTPSGSLSGSQDDSDSDMTFSVNQSSSASESSLVTAPSSPLSPPVSPVFSPPEPAGIKNGECTVCFDGEVDTVIYTCGHMCLCHSCGLRLKRQARACCPICRRPIKDVIKIYRP

SEQ ID NO: 13963 - protein, 1560 aa, Homo sapiens
MAAGSGGSGGSGGGPGPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEAFMVSPAQARPETFPNSLESHNDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQVRIDFLNRQWTSSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQVCVRPGSYTPGPPSAALGEPPDPHFSPAELEWVTKEKGATLLCALLVRVE

SEQ ID NO: 13964 - protein, 1562 aa, Homo sapiens
MAAGSGGSGGSGGGPGPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEAFMVSPAQARPETFPNSLESHNDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPGKEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQVRIDFLNRQWTSSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQVCVRPGSYTPGPPSAALGEPPDPHFSPAELEWVTKEKGATLLCALLVRVE

SEQ ID NO: 13965 - protein, 919 aa, Homo sapiens
MVKQNNIIPGETQILLRFTGWESKVNAKKQLPVGIKCEPMDQVPDSTSSATNVSMVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 13966 - protein, 790 aa, Homo sapiens
MFSNSTGRLPGQPTQEIQQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 13967 - protein, 366 aa, Homo sapiens
LASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLCYSTPSSCLEQPDSCQPYGSSFYALEEKHVGFSLDVGEIEKKGKGKKRRGRRSKKKRRRGRKEGEEDQNPPCPRLSSVLMEVEVPEVLQDSLDRYYSTPSMYFELPDSFQHYRSVFYSFEEQHISFALDMDNRFFTLTVRSLHLVFQMGVIFPQ

SEQ ID NO: 13968 - protein, 838 aa, Homo sapiens
MVVSAGPWSSEKAEMNILEINEKLRPQLAENKQQFRNLKERCFLTQLAGFLANRHKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKPKSHLRKTKSTQLSLAHPLMLNGRMLYTLSQKMKVMMRKRKKKGQCLPGICRSLKRRKSPRSPGMKVIRLSQFLLKGHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 13969 - protein, 85 aa, Homo sapiens
EMQKAEEKEVPEDSLEECAITCSNSHGPYDSNQPHRKTKITFEEDKVDSTLIGSSSHVEWEDAVHIIPENESDDEEEEEKGPVSP

SEQ ID NO: 13970 - protein, 1189 aa, Homo sapiens
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGSPLAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13971 - protein, 1257 aa, Homo sapiens
MARQPPPPWVHAAFLLCLLSLGGAIEIPMDPNPQHRLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGSPVMSPPTLPPTTVGATGAVSSTDATAIAATTEATTVPIIPTVAPTTIATTTTVATTTTTTAAATTTTESPPTTTSGTKIHESAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13972 - protein, 1224 aa, Homo sapiens
MARQPPPPWVHAAFLLCLLSLGGAIEIPMDPNPQHRLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13973 - protein, 1240 aa, Homo sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13974 - protein, 1169 aa, Homo sapiens
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13975 - protein, 1071 aa, Homo sapiens
MARQPPPPWVHAAFLLCLLSLGGAIEIPMDPNPQHRLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGSPVMSYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13976 - protein, 1268 aa, Homo sapiens
MARQPPPPWVHAAFLLCLLSLGGAIEIPMDPNPQHRLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGSPVMSPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13977 - protein, 1332 aa, Homo sapiens
MARQPPPPWVHAAFLLCLLSLGGAIEIPMDLSIETTVTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGRCMAAAPGVKGPSVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13978 - protein, 1347 aa, Homo sapiens
MARQPPPPWVHAAFLLCLLSLGGAIEIPMDPNPQHRLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEGSPVMSPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13979 - protein, 1240 aa, Homo sapiens; identical to SEQ ID NO: 13973

SEQ ID NO: 13980 - protein, 619 aa, Homo sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGNCPCSPWH

SEQ ID NO: 13981 - protein, 1174 aa, Homo sapiens
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13982 - protein, 1165 aa, Homo sapiens
IEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 13983 - protein, 302 aa, Homo sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALR

SEQ ID NO: 13984 - protein, 129 aa, Homo sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALS

SEQ ID NO: 13985 - protein, 1169 aa, Homo sapiens; identical to SEQ ID NO: 13974

SEQ ID NO: 13986 - protein, 1174 aa, Homo sapiens; identical to SEQ ID NO: 13981

SEQ ID NO: 13987 - protein, 500 aa, Homo sapiens
LKFLAVLLAAGMLAFLGAVICIIASVPLAASPARALPGGADNASVASGAAASPGPQRSLSALHGAGGSAGPPALPGAPAASAHPLPPGPLFSRFLCTPLAAACPSGAQQGDAAGAAPGEREELLLLQSTAEQLRQTALQQEARIRADQDTIRELTGKLGRCESGLPRGLQGAGPRRDTMADGPWDSPALILELEDAVRALRDRIDRLEQELPARVNLSAAPAPVSAVPTGLHSKMDQLEGQLLAQVLALEKERVALSHSSRRQRQEVEKELDVLQGRVAELEHGSSAYSPPDAFKISIPIRNNYMYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 13988 - protein, 841 aa, Homo sapiens
MNLLYRKTKLEWRQHKEEEAKRSSSKEVAPAGSAGPAAGQGPGVRVRDIASLRRSLRMGFMTMPASQEHTPHPCRSAMAPRSLSCHSVGSMDSVGGGPGGASGGLTEDSSTRRPPAKPRRHPSTKLSMVGPGSGAETPPSKKAGSQKPTPEGRESSRKVPPQKPRRSPNTQLSVSFDESCPPGPSPRGGNLPLQRLTRGSRVAGDPDVGAQEEPVYIEMVGDVFRGGGRSGGGLAGPPLGGGGPTPPAGADSDSEESEAIYEEMKYPLPEEAGEGRANGPPPLTATSPPQQPHALPPHAHRRPASALPSRRDGTPTKTTPCEIPPPFPNLLQHRPPLLAFPQAKSASRTPGDGVSRLPVLCHSKEPAGSTPAPQVPARERETPPPPPPPPAANLLLLGPSGRARSHSTPLPPQGSGQPRGERELPNSHSMICPKAAGAPAAPPAPAALLPGPPKDKAVSYTMVYSAVKVTTHSVLPAGPPLGAGEPKTEKEISVLHGMLCTSSRPPVPGKTSPHGGAMGAAAGVLHHRGCLASPHSLPDPTVGPLTPLWTYPATAAGLKRPPAYESLKAGGVLNKGCGVGAPSPMVKIQLQEQGTDGGAFASISCAHVIASAGTPEEEEEEVGAATFGAGWALQRKVLYGGRKAKELDKVEDGARAWNGSAEGPGKVEREDRGPGTSGIPVRSQGAEGLLARIHHGDRGGSRTALPIPCQTFPACHRNGDFTGGYRLGRSASTSGVRQVVLHTPRPCSQPRDALSQPHPALPLPLPLPPQPARERDGKLLEVIERKRCVCKEIKARHRPDRGLCKQESMPILPSWRRGPEPRKSGTPPCRRQHTVLWDTAI

SEQ ID NO: 13989 - protein, 842 aa, Homo sapiens
MNLLYRKTKLEWRQHKEEEAKRSSSKEVAPAGSAGPAAGQGPGVRVRDIASLRRSLRMGFMTMPASQEHTPHPCRSAMAPRSLSCHSVGSMDSVGGGPGGASGGLTEDSSTRRPPAKPRRHPSTKLSMVGPGSGAETPPSKKAGSQKPTPEGRESSRKVPPQKPRRSPNTQLSVSFDESCPPGPSPRGGNLPLQRLTRGSRVAGDPDVGAQEEPVYIEMVGDVFRGGGRSGGGLAGPPLGGGGPTPPAGADSDSEESEAIYEEMKYPLPEEAGEGRANGPPPLTATSPPQQPHALPPHAHRRPASALPSRRDGTPTKTTPCEIPPPFPNLLQHRPPLLAFPQAKSASRTPGDGVSRLPVLCHSKEPAGSTPAPQVPARERETPPPPPPPPAANLLLLGPSGRARSHSTPLPPQGSGQPRGERELPNSHSMICPKAAGAPAAPPAPAALLPGPPKDKAVSYTMVYSAVKVTTHSVLPAGPPLGAGEPKTEKEISVLHGMLCTSSRPPVPGKTSPHGGAMGAAAGVLHHRGCLASPHSLPDPTVGPLTPLWTYPATAAGLKRPPAYESLKAGGVLNKGCGVGAPSPMVKIQLQEQGTDGGAFASISCAHVIASAGTPEEEEEEVGAATFGAGWALQRKVLYGGRKAKELDTEVEDGARAWNGSAEGPGKVEREDRGPGTSGIPVRSQGAEGLLARIHHGDRGGSRTALPIPCQTFPACHRNGDFTGGYRLGRSASTSGVRQVVLHTPRPCSQPRDALSQPHPALPLPLPLPPQPARERDGKLLEVIERKRCVCKEIKARHRPDRGLCKQESMPILPSWRRGPEPRKSGTPPCRRQHTVLWDTAI

SEQ ID NO: 13990 - protein, 785 aa, Homo sapiens
MGFMTMPASQEHTPHPCRSAMAPRSLSCHSVGSMDSVGGGPGGASGGLTEDSSTRRPPAKPRRHPSTKLSMVGPGSGAETPPSKKAGSQKPTPEGRESSRKVPPQKPRRSPNTQLSVSFDESCPPGPSPRGGNLPLQRLTRGSRVAGDPDVGAQEEPVYIEMVGDVFRGGGRSGGGLAGPPLGGGGPTPPAGADSDSEESEAIYEEMKYPLPEEAGEGRANGPPPLTATSPPQQPHALPPHAHRRPASALPSRRDGTPTKTTPCEIPPPFPNLLQHRPPLLAFPQAKSASRTPGDGVSRLPVLCHSKEPAGSTPAPQVPARERETPPPPPPPPAANLLLLGPSGRARSHSTPLPPQGSGQPRGERELPNSHSMICPKAAGAPAAPPAPAALLPGPPKDKAVSYTMVYSAVKVTTHSVLPAGPPLGAGEPKTEKEISVLHGMLCTSSRPPVPGKTSPHGGAMGAAAGVLHHRGCLASPHSLPDPTVGPLTPLWTYPATAAGLKRPPAYESLKAGGVLNKGCGVGAPSPMVKIQLQEQGTDGGAFASISCAHVIASAGTPEEEEEEVGAATFGAGWALQRKVLYGGRKAKELDTEVEDGARAWNGSAEGPGKVEREDRGPGTSGIPVRSQGAEGLLARIHHGDRGGSRTALPIPCQTFPACHRNGDFTGGYRLGRSASTSGVRQVVLHTPRPCSQPRDALSQPHPALPLPLPLPPQPARERDGKLLEVIERKRCVCKEIKARHRPDRGLCKQESMPILPSWRRGPEPRKSGTPPCRRQHTVLWDTAI

SEQ ID NO: 13991 - protein, 653 aa, Homo sapiens
MISSKMMSSNPEEDPLDTFLQYIEDMGMKAYDGLVIQNASDIARENDRLRNETNLAYLKEKNEKRRRQEEAIKRIGGEVGRGHEGSYVGKHFRMGFMTMPAPQDRLPHPCSSGFSVRSQSLHSVGGTDDDSSCGSRRQPPPKPKRDPSTKLSTSSETVSSTAASKSGKTPERTEASAKPRPHSDEYSKKIPPPKPKRNPNTQLSTSFDETYIKKHGPRRTSLPRDSSLSQMGSPAGDPEEEEPVYIEMVGNILRDFRKEDDDQSEAVYEEMKYPIFDDLGQDAKCDFDHHSCSSQCATPTVPDLDFAKASVPCPPKGLLCDIPPPFPNLLSHRPPLLVFPPAPVHCSPNSDESPLTPLEVTKLPVLENVSYMKQPAGASPSTLPSHVPGHAKLEKEQAAALGPASATPALSSSPPPPSTLYRTQSPHGYPKSHSTSPSPVSMGRSLTPLSLKRPPPYDAVHSGSLSRSSPSVPHSTPRPVSQDGAKMVNAAVNTYGAAPGGSRSRTPTSPLEELTSLFSSGRSLLRKSSSGRRSKEPAEKSTEELKVRSHSTEPLPKLDNKERGHHGASSSREPVKAQEWDGTPGTPVVTSRLGRCSVSPTLLAGNHSSEPKVSCKLGRSASTSGVPPPSVTPLRQSSDLQQSQVPSSLANRD

SEQ ID NO: 13992 - protein, 144 aa, Homo sapiens
MISSKMMSSNPEEDPLDTFLQYIEDMGMKAYDGLVIQNASDIARENDRLRNETNLAYLKEKNEKRRRQEEAIKRINRGTESPKPQHGAITKVGQQGKRPPWGVFLQRACQSSGMGWNTRDTCGHQSTRKMLCEPHLVSGKPQFR

SEQ ID NO: 13993 - protein, 165 aa, Homo sapiens
LAWRPGERGAPASRPRLALLLLLLLLPLPSGAWYKHVASPRYHTVGRAAGLLMGLRRSPYLWRRALRAAAGPLARDTLSPEPAAREAPLLLPSWVQELWETRRRSSQAGIPVRAPRSPRAPEPALEPESLDFSGAGQRLRRDVSRPAVDPAANRLGLPCLAPGPF

SEQ ID NO: 13994 - protein, 419 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13995 - protein, 402 aa, Homo sapiens
MPPVSRSSYSEDIVGSRRRRRSSSGSPPSPQSRCSSWDGCSRSHSRGREGLRPPWSELDVGALYPFSRSGSRGRLPRFRNYAFASSWSTSYSGYRYHRHCYAEERQSAEDYEKEESHRQRRLKERERIGELGAPEVWGPSPKFPQLDSDEHTPVEDEEEVTHQKSSSSDSNSEEHRKKKTSRSRNKKKRKNKSSKRKHRKYSDSDSNSESDTNSDSDDDKKRVKAKKKKKKKKHKTKKKKNKKTKKESSDSSCKDSEEDLSEATWMEQPNVADTMDLIGPEAPIIHTSQDEKPLKYGHALLPGEGAAMAEYVKAGKRIPRRGEIGLTSEEIGSFECSGYVMSGSRHRRMEAVRLRKENQIYSADEKRALASFNQEERRKRESKILASFREMVHKKTKEKDDK

SEQ ID NO: 13996 - protein, 191 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 13997 - protein, 726 aa, Homo sapiens
MAAPGGRGRSLSGLLPAQTSLEYALLDAVTQQEKDSLVYQYLQKVDGWEQDLSVPEFPEGLEWLNTEEPISVYKDLCGKIVVLDFFTYCCINCIHLLPDLHALEHTYSDKDGLLIIGVHSAKFPNEKVLDNIKSAVLRYNITHPMVNDADASLWQELEVSCWPTLVILGPRGNMLFSLIGEGHKDKLFLYTSIALKYYKDRGQIRDNKIGIKLYKDSLPPSPLLFPGKVTVDQVTDRLVIADTGHHRILVVWKNGQIQYSIGGPNPGRKDGIFSESTFNSPQGVAIMNNIIYVADTENHLIRKIDLEAEKVSTVAGIGIQGTDKEGGAKGEQQPISSPWDVVFGTSGSEVQRGDILWIAMAGTHQIWALLLDSGKLPKKNELTKGTCLRFAGSGNEENRNNAYPHKAGFAQPSGLSLASEDPWSCLFVADSESSTVRTVSLKDGAVKHLVGGERDPMNLFAFGDVDGVGINAKLQHPLGVTWDKKRNLLYVADSYNHKIKVVDPKTKNCTTLAGTGDTNNVTSSSFTESTFNEPGGLCIGENGELLYVADTNNHQIKVMDLETKMVSVLPIFRSENAVVDGPFLVEKQKTLPKLPKSAPSIRLSPVTACAGQTLQFKLRLDLPSGSKLTEGVSSCWFLTAEGNEWLLQGQIAAGDIENISSQPTISLQIPDDCLSLEAIVSVSVFLYYCSADSSACMMKAILFSQPLQITDTQQGCIAPVELRYVF

SEQ ID NO: 13998 - protein, 123 aa, Homo sapiens
MLGLEGPCWVGPGPDGGLAVSEEFGDVRLFGSARQPLGSLGGWTGHTFGCPAGICSNSEGNVIVADEQRRQVTLFPRAGPPICLVSEGLGQPLGVACAPQGQLLVADAKDNSIKVYQGLKELA

SEQ ID NO: 13999 - protein, 123 aa, Homo sapiens; identical to SEQ ID NO: 13998

SEQ ID NO: 14000 - protein, 1606 aa, Homo sapiens
MVVFINAKIKSLIKLFKKKTVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITGENFDRQASLRRSLIYTDTLVRRPKKVKRRKTITGVPDNIQKELASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 14001 - protein, 1610 aa, Homo sapiens
MKKEGSSGSFRLQPNTGSLSRAVSWINFSSLSRQTKRLFRSDGELSVCGQQVEVDDENWIYRAQPRKAVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 14002 - protein, 709 aa, Homo sapiens
MESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLG

SEQ ID NO: 14003 - protein, 709 aa, Homo sapiens; identical to SEQ ID NO: 14002

SEQ ID NO: 14004 - protein, 1225 aa, Homo sapiens
MPFYRRTVVPQRLCPRNPPQQLAELRDVSHLAALSLLRQLADLCGHSLALLEDLEGHLLALGRRTDSLYRRTVRLRRRLPCRLLGPEEDEEELAAANSGRENATATAHSRSSWRQPVNVFLSSGRPPSVEELLREAQLNLQSLLQEEYEEQYSEARLVGQTFRSSDEATKPTPNPRPQSARRLEFILMPTKRQLSEDETTTQGVRAPEASLSLSTTADKQTAWNSLFPLPILEEKRWPQLCSTQSDIVPINISGQQFDKHASLRHSLFNTETAVNPKSTLRRRRTIIGFSNFSQRDQGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIHRSKRKLLGWKEPGEAFVGGRTSSHSPIKNTAESPISESTATAGSGSSANLDAGRNDDFKALLQKKGSKATPRSRPSAAELLKTTNPLARRIIAQFSKDYETTDNPST

SEQ ID NO: 14005 - protein, 712 aa, Homo sapiens
MPDQDKKVKTTEKSTDKQQEITIRDYSDLKRLRCLLNVQSSKQQLPAINFDSAQNSMTKSEPAIRAGGHRARGQWHESTEAVELENFSINYKNERNFSKHPQRKLFQEIFTALVKNRLISREWVNRAPSIHFLRVLICLRLLMRDPCYQEILHSLGGIENLAQYMEIVANEYLGYGEEQHTVDKLVNMTYIFQKLAAVKDQREWVTTSGAHKTLVNLLGARDTNVLLGSLLALASLAESQECREKISELNIVENLLMILHEYDLLSKRLTAELLRLLCAEPQVKEQVKLYEGIPVLLSLLHSDHLKLLWSIVWILVQVCEDPETSVEIRIWGGIKQLLHILQGDRNFVSDHSSIGSLSSANAAGRIQQLHLSEDLSPREIQENTFSLQAACCAALTELVLNDTNAHQVVQENGVYTIAKLILPNKQKNAAKSNLLQCYAFRALRFLFSMERNRPLFKRLFPTDLFEIFIDIGHYVRDISAYEELVSKLNLLVEDELKQIAENIESINQNKAPLKYIGNYAILDHLGSGAFGCVYKVRKHSGQNLLAMKEVNLHNPAFGKDKKDRDSSVRNIVSELTIIKEQLYHPNIVRYYKTFLENDRLYIVMELIEGAPLGEHFSSLKEKHHHFTEERLWKIFIQLCLALRYLHKEKRIVHRDLTPNNIMLGDKDKVTVTDFGLAKQKQENSKLTSVVGTILYSCVQHLYLRSPAPALAT

SEQ ID NO: 14006 - protein, 404 aa, Homo sapiens
MELIEGAPLGEHFSSLKEKHHHFTEERLWKIFIQLCLALRYLHKEKRIVHRDLTPNNIMLGDKDKVTVTDFGLAKQKQENSKLTSVVGTILYSCPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPALLPLDLLLKVPPHMLRAHIKEIEAELVTGWQSHSLPAVILRNLKDHGSTY

SEQ ID NO: 14007 - protein, 427 aa, Homo sapiens
MVPVQPAEPPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 14008 - protein, 474 aa, Homo sapiens
MVPVQPAEPPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPALLPLDLLLKVPPHMLRAHIKEIEAELVTGWQSHSLPAVILRNLKDHASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 14009 - protein, 725 aa, Homo sapiens [sequence omitted]

SEQ ID NO: 14010 - protein, 96 aa, Homo sapiens
MPDQDKKVKTTEKSTDKQQEITIRDYSDLKRLRCLLNVQSSKQQLPAINFDSAQNSMTKSEPAIRAGGHRARGQWHESTEAVELENFSINYKNERN

SEQ ID NO: 14011 - protein, 133 aa, Homo sapiens
MPDQDKKVKTTEKSTDKQQEITIRDYSDLKRLRCLLNVQSSKQQLPAINFDSAQNSMTKSEPAIRAGGHRARGQWHESTEAVELENFSINYKNERNFSKHPQRKLFQEIFTALVKNRLISREWVNRAPSIHFL

SEQ ID NO: 14012 - protein, 708 aa, Homo sapiens
MDKYDVIKAIGQGAFGKAYLAKGKSDSKHCVIKEINFEKMPIQEKEASKKEVILLEKMKHPNIVAFFNSFQENGRLFIVMEYCDGGDLMKRINRQRGVLFSEDQILGWFVQISLGLKHIHDRKILHRDIKAQNIFLSKNGMVAKLGDFGIARVLNNSMELARTCIGTPYYLSPEICQNKPYNNKTDIWSLGCVLYELCTLKHPFEGNNLQQLVLKICQAHFAPISPGFSRELHSLISQLFQVSPRDRPSINSILKRPFLENLIPKYLTPEVIQEEFSHMLICRAGAPASRHAGKVVQKCKIQKVRFQGKCPPRSRISVPIKRNAILHRNEWRPPAGAQKARSIKMIERPKIAAVCGHYDYYYAQLDMLRRRAHKPSYHPIPQENTGVEDYGQETRHGPSPSQWPAEYLQRKFEAQQYKLKVEKQLGLRPSSAEPNYNQRQELRSNGEEPRFQELPFRKNEMKEQEYWKQLEEIRQQYHNDMKEIRKKMGREPEENSKISHKTYLVKKSNLPVHQDASEGEAPVQMEFRSCCPGWSAMARSWLTATSASQDIEKDLKQMRLQNTKESKNPEQKYKAKKGVKFEINLDKCISDENILQEEEAMDIPNETLTFEDGMKFKEYECVKEHGDYTDKAFEKLHCPEAGFSTQTVAAVGNRRQWDGGAPQTLLQMMAVADITSTCPTGPDSESVLSVSRQEGKTKDPYSPVLILM

SEQ ID NO: 14013 - protein, 142 aa, Homo sapiens
MNINPCLVLCECSLSISLDADPLVSPFATGPCPGAPREVVAMQSDVGQGFPMQSNWRAPVHACTSGAVRKGWPGCGRRRHKMGGGPVSWEQRQKEVEAAQGSEERGPGSLAVSLLSLAVGIHRISPILGFHICCMQVLMVLK

SEQ ID NO: 14014 - protein, 247 aa, Homo sapiens
MLVLRSGLTKALASRTLAPQVCSSFATGPRQYDGTFYEFRTYYLKPSNMNAFMENLKKNIHLRTSYSELVGFWSVEFGGRTNKVFHIWKYDNFAHRAEVRKALANCKEWQEQSIIPNLARIDKQETEITYLIPWSKLEKPPKEGVYELAVFQMKPGGPALWGDAFERAINAHVNLGYTKVVGVFHTEYGELNRVHVLWWNESADSRAAGRHKSHEDPRVVAAVRESVNYLVSQQNMLLIPASFSPLK

SEQ ID NO: 14015 - protein, 543 aa, Homo sapiens
MRDNTSPISVILVSSGSRGNKLLFRYPFQRSQEHPASQTSKPRSRYAASNTGDHADEQDGDSRFSDVILATILATKSEMCGQKFELKIDNVRFVGHPTLLQHALGQANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASSEHERAAILSVPAAQNPEDLRMFARLLHYFRGRHHLEEIMYNENTRRSQLLMLFDKFRSVLVVTTHEDPVIAVFQALLP

SEQ ID NO: 14016 - protein, 389 aa, Homo sapiens
MADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLGQLSEHERAAILSVPAAQNPEDLRMFARLLHYFRGRHHLEEIMYNENTRRSQLLMLFDKFRSVLVVTTHEDPVIAVFQALLP

SEQ ID NO: 14017 - protein, 568 aa, Homo sapiens
MRDNTSPISVILVSSGSRGNKLLFRYPFQRSQEHPASQTSKPRSRYAASNTGDHADEQDGDSRFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASSEHERAAILSVPAAQNPEDLRMFARLLHYFRGRHHLEEIMYNENTRRSQLLMLFDKFRSVLVVTTHEDPVIAVFQALLP

SEQ ID NO: 14018 - protein, 69 aa, Homo sapiens
MRDNTSPISVILVSSGSRGNKLLFRYPFQRSQEHPASQTSKPRSRYAASNTGDHADEQDGDSRPTQTRQ

SEQ ID NO: 14019 - protein, 332 aa, Homo sapiens
MLAWQDGGAKAAPSHHKISFSVLDILDPQKFTRAALPAVRPAPREARKSLAEVEAGKDASSRDPVRQLETPGQGFAASLLTRQAHPHHSSDARDAAGPGAGQASPLEGSEAEEEEDAEDPRRPRLRERAARLLPGLARSPDAPAGALASGEPCEDGGGGPVRSPPGSPGSPRPRRRRLEPNCAKPRRARTAFTYEQLVALENKFRATRYLSVCERLNLALSLSLTETQVKIWFQNRRTKWKKQNPGADGAAQVGGGAPQPGAAGGGGGGGSGGSPGPPGTGALHFQTFPSYSAANVLFPSAASFPLTAAAPGSPFAPFLGPSYLTPFYAPRL

SEQ ID NO: 14020 - protein, 310 aa, Homo sapiens
MLAWQDGGAKAAPSHHKISFSVLDILDPQKFTRAALPAVRPAPREARKSLAEVEAGKDASSRDPVRQLETPDAAGPGAGQASPLEGSEAEEEEDAEDPRRPRLRERAARLLPGLARSPDAPAGALASGEPCEDGGGGPVRSPPGSPGSPRPRRRRLEPNCAKPRRARTAFTYEQLVALENKFRATRYLSVCERLNLALSLSLTETQVKIWFQNRRTKWKKQNPGADGAAQVGGGAPQPGAAGGGGGGGSGGSPGPPGTGALHFQTFPSYSAANVLFPSAASFPLTAAAPGSPFAPFLGPSYLTPFYAPRL

SEQ ID NO: 14021 - protein, 37 aa, Homo sapiens
EEWITYSNSCYYIGKERRTWEERVCWPVLRRTLICFL

SEQ ID NO: 14022 - protein, 1040 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 14023 - protein, 1062 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 14024 - protein, 1062 aa, Homo sapiens; identical to SEQ ID NO: 14023

SEQ ID NO: 14025 - protein, 1062 aa, Homo sapiens; identical to SEQ ID NO: 14023

SEQ ID NO: 14026 - protein, 1062 aa, Homo sapiens; identical to SEQ ID NO: 14023

SEQ ID NO: 14027 - protein, 1062 aa, Homo sapiens; identical to SEQ ID NO: 14023

SEQ ID NO: 14028 - protein, 1040 aa, Homo sapiens; identical to SEQ ID NO: 14022

SEQ ID NO: 14029 - protein, 1062 aa, Homo sapiens; identical to SEQ ID NO: 14023

SEQ ID NO: 14030 - protein, 1062 aa, Homo sapiens; identical to SEQ ID NO: 14023

SEQ ID NO: 14031 - protein, 1062 aa, Homo sapiens; identical to SEQ ID NO: 14023

SEQ ID NO: 14032 - protein, 1062 aa, Homo sapiens; identical to SEQ ID NO: 14023

SEQ ID NO: 14033 - protein, 1040 aa, Homo sapiens; identical to SEQ ID NO: 14022

SEQ ID NO: 14034 - protein, 1040 aa, Homo sapiens; identical to SEQ ID NO: 14022

SEQ ID NO: 14035 - protein, 1062 aa, Homo sapiens; identical to SEQ ID NO: 14023

SEQ ID NO: 14036 - protein, 1040 aa, Homo sapiens; identical to SEQ ID NO: 14022

SEQ ID NO: 14037 - protein, 1062 aa, Homo sapiens; identical to SEQ ID NO: 14023

SEQ ID NO: 14038 - protein, 1062 aa, Homo sapiens; identical to SEQ ID NO: 14023

SEQ ID NO: 14039 - protein, 1062 aa, Homo sapiens; identical to SEQ ID NO: 14023

SEQ ID NO: 14040 - protein, 1040 aa, Homo sapiens; identical to SEQ ID NO: 14022

SEQ ID NO: 14041 - protein, 1040 aa, Homo sapiens; identical to SEQ ID NO: 14022

SEQ ID NO: 14042 - protein, 1062 aa, Homo sapiens; identical to SEQ ID NO: 14023

SEQ ID NO: 14043 - protein, 980 aa, Homo sapiens
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLKTYETNLEIKKLLEEVKEKNPKLTIDCNASGATAPPCCDFFC

SEQ ID NO: 14044 - protein, 1009 aa, Homo sapiens
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFESSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 14045 - protein, 1065 aa, Homo sapiens
MSRKHRLEARPDLREFFSLNLRSHTRSTMTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 14046 - protein, 1009 aa, Homo sapiens; identical to SEQ ID NO: 14044

SEQ ID NO: 14047 - protein, 1065 aa, Homo sapiens; identical to SEQ ID NO: 14045

SEQ ID NO: 14048 - protein, 1009 aa, Homo sapiens; identical to SEQ ID NO: 14044

SEQ ID NO: 14049 - protein, 1065 aa, Homo sapiens; identical to SEQ ID NO: 14045

SEQ ID NO: 14050 - protein, 980 aa, Homo sapiens; identical to SEQ ID NO: 14043

SEQ ID NO: 14051 - protein, 1009 aa, Homo sapiens; identical to SEQ ID NO: 14044

SEQ ID NO: 14052 - protein, 980 aa, Homo sapiens; identical to SEQ ID NO: 14043

SEQ ID NO: 14053 - protein, 980 aa, Homo sapiens; identical to SEQ ID NO: 14043

SEQ ID NO: 14054 - protein, 980 aa, Homo sapiens; identical to SEQ ID NO: 14043

SEQ ID NO: 14055 - protein, 1065 aa, Homo sapiens; identical to SEQ ID NO: 14045

SEQ ID NO: 14056 - protein, 1065 aa, Homo sapiens; identical to SEQ ID NO: 14045

SEQ ID NO: 14057 - protein, 980 aa, Homo sapiens; identical to SEQ ID NO: 14043

SEQ ID NO: 14058 - protein, 1009 aa, Homo sapiens; identical to SEQ ID NO: 14044

SEQ ID NO: 14059 - protein, 1009 aa, Homo sapiens; identical to SEQ ID NO: 14044

SEQ ID NO: 14060 - protein, 1065 aa, Homo sapiens; identical to SEQ ID NO: 14045

SEQ ID NO: 14061 - protein, 1037 aa, Homo sapiens
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 14062 - protein, 1037 aa, Homo sapiens; identical to SEQ ID NO: 14061

SEQ ID NO: 14063 - protein, 1037 aa, Homo sapiens; identical to SEQ ID NO: 14061

SEQ ID NO: 14064 - protein, 1037 aa, Homo sapiens; identical to SEQ ID NO: 14061

SEQ ID NO: 14065 - protein, 1037 aa, Homo sapiens; identical to SEQ ID NO: 14061

SEQ ID NO: 14066 - protein, 1037 aa, Homo sapiens; identical to SEQ ID NO: 14061

SEQ ID NO: 14067 - protein, 1037 aa, Homo sapiens; identical to SEQ ID NO: 14061

SEQ ID NO: 14068 - protein, 359 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 14069 - protein, 1837 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVKVEDGADVSISDLFNTRVNKGPRVTVLLGKAGMGKTTLAHRLCQKWAEGHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVTEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 14070 - protein, 850 aa, Homo sapiens
MASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSSLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRDSTRHTEKLSFPTLEACALGFK

SEQ ID NO: 14071 - protein, 1551 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVKVEDGADVSISDLFNTRVNKGPRVTVLLGKAGMGKTTLAHRLCQKWAEGHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGRFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVTEISISETQQQLCVQLEFPRQEENPEAVALRLAHCDLGAHHSLLVGQLMETCARLQQLSLSQVNLCEDDDASSLLLQSLLLSLSELKTFRIQSSQDPGRLLPDLLPFDPHQADLQLCEHRGPRPPGIWSGPLPPLGGAGLV

SEQ ID NO: 14072 - protein, 19 aa, Homo sapiens
MDPVGLQLGNKNLWSCLVR

SEQ ID NO: 14073 - protein, 74 aa, Homo sapiens
MDPVGLQLGNKNLWSCLVRLLTKDPEWLNAKMKFFLPNTDLDSRNETLDPEQRVILQLNKLHVQGSDTWQSFIH

SEQ ID NO: 14074 - protein, 655 aa, Homo sapiens
MAMAKARKPREALLWALSDLEENDFKKLKFYLRDMTLSEGQPPLARGELEGLIPVDLAELLISKYGEKEAVKVVLKGLKVMNLLELVDQLSHICLHDYREVYREHVRCLEEWQEAGVNGRYNQVLLVAKPSSESPESLACPFPEQELESVTVEALFDSGEKPSLAPSLVVLQGSAGTGKTTLARKMVLDWATGTLYPGRFDYVFYVSCKEVVLLLESKLEQLLFWCCGDNQAPVTEILRQPERLLFILDGFDELQRPFEEKLKKRGLSPKESLLHLLIRRHTLPTCSLLITTRPLALRNLEPLLKQARHVHILGFSEEERARYFSSYFTDEKQADRAFDIVQKNDILYKACQVPGICWVVCSWLQGQMERGKVVLETPRNSTDIFMAYVSTFLPPDDDGGCSELSRHRVLRSLCSLAAEGIQHQRFLFEEAELRKHNLDGPRLAAFLSSNDYQLGLAIKKFYSFRHISFQDFFHAMSYLVKEDQSRLGKESRREVQRLLEVKEQEGNDEMTLTMQFLLDISKKDSFSNLELKFCFRISPCLAQDLKHFKEQMESMKHNRTWDLEFSLYEAKIKNLVKGIQMNNVSFKIKHSNEKKSQSQNLFSVKSSLSHGPKEEQKCPSVHGQKEGKDNIAGTQKEASTGKGRGTEETPKNTYI

SEQ ID NO: 14075 - protein, 66 aa, Homo sapiens
MAMAKARKPREALLWALSDLEENDFKKLKFYLRDMTLSEGQPPLARGELEGLIPVDLAELLISKYG

SEQ ID NO: 14076 - protein, 979 aa, Homo sapiens
MAESDSTDFDLLWYLENLSDKEFQSFKKYLARKILDFKLPQFPLIQMTKEELANVLPISYEGQYIWNMLFSIFSMMRKEDLCRKIIGRRNRNQEACKAVMRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTARLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVTFPLLFPTCQLEELHLSGCFFSSDICQYIAIVIATNEKLRSLEIGSNKIEDAGMQLLCGGLRHPNCMLVNIGLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 14077 - protein, 1033 aa, Homo sapiens
MAESDSTDFDLLWYLENLSDKEFQSFKKYLARKILDFKLPQFPLIQMTKEELANVLPISYEGQYIWNMLFSIFSMMRKEDLCRKIIGRRNRNQEACKAVMRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTASQMKSLVYWREICSLFYTMESLRELHIFDNDLNGISERILSKALEHSSCKLRTLKLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVTFPLLFPTCQLEELHLSGCFFSSDICQYIAIVIATNEKLRSLEIGSNKIEDAGMQLLCGGLRHPNCMLVNIGLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 14078 - protein, 1043 aa, Homo sapiens
MNFSVITCPNGGTNQGLLPYLMALDQYQLEEFKLCLEPQQLMDFWSAPQGHFPRIPWANLRAADPLNLSFLLDEHFPKGQAWKVVLGIFQTMNLTSLCEKVRAEMKENVQTQELQDPTQEDLEMLEAAAGNMQTQGCQDPNQEELDELEEETGNVQAQGCQDPNQEEPEMLEEADHRRKYRENMKAELLETWDNISWPKDHVYIRNTSKDEHEELQRLLDPNRTRAQAQTIVLVGRAGVGKTTLAMQAMLHWANGVLFQQRFSYVFYLSCHKIRYMKETTFAELISLDWPDFDAPIEEFMSQPEKLLFIIDGFEEIIISESRSESLDDGSPCTDWYQELPVTKILHSLLKKELVPLATLLITIKTWFVRDLKASLVNPCFVQITGFTGDDLRVYFMRHFDDSSEVEKILQQLRKNETLFHSCSAPMVCWTVCSCLKQPKVRYYDLQSITQTTTSLYAYFFSNLFSTAEVDLADDSWPGQWRALCSLAIEGLWSMNFTFNKEDTEIEGLEVPFIDSLYEFNILQKINDCGGCTTFTHLSFQEFFAAMSFVLEEPREFPPHSTKPQEMKMLLQHVLLDKEAYWTPVVLFFFGLLNKNIARELEDTLHCKISPRVMEELLKWGEELGKAESASLQFHILRLFHCLHESQEEDFTKKMLGRIFEVDLNILEDEELQASSFCLKHCKRLNKLRLSVSSHILERDLEILETSKFDSRMHAWNSICSTLVTNENLHELDLSNSKLHASSVKGLCLALKNPRCKVQKLTCKSVTPEWVLQDLIIALQGNSKLTHLNFSSNKLGMTVPLILKALRHSACNLKYLCLEKCNLSAASCQDLALFLTSIQHVTRLCLGFNRLQDDGIKLLCAALTHPKCALERLELWFCQLAAPACKHLSDALLQNRSLTHLNLSKNSLRDEGVKFLCEALGRPDGNLQSLNLSGCSFTREGCGELANALSHNHNVKILDLGENDLQDDGVKLLCEALKPHRALHTLGLAKCNLTTACCQHLFSVLSSSKSLVNLNLLGNELDTDGVKMLCKALKKSTCRLQKLG

SEQ ID NO: 14079 - protein, 1093 aa, Homo sapiens
MADSSSSSFFPDFGLLLYLEELNKEELNTFKLFLKETMEPEHGLTPWNEVKKARREDLANLMKKYYPGEKAWSVSLKIFGKMNLKDLCERAKEEINWSAQTIGPDDAKAGETQEDQEAVLGDGTEYRNRIKEKFCITWDKKSLAGKPEDFHHGIAEKDRKLLEHLFDVDVKTGAQPQIVVLQGAAGVGKTTLVRKAMLDWAEGSLYQQRFKYVFYLNGREINQLKERSFAQLISKDWPSTEGPIEEIMYQPSSLLFIIDSFDELNFAFEEPEFALCEDWTQEHPVSFLMSSLLRKVMLPEASLLVTTRLTTSKRLKQLLKNHHYVELLGMSEDAREEYIYQFFEDKRWAMKVFSSLKSNEMLFSMCQVPLVCWAACTCLKQQMEKGGDVTLTCQTTTALFTCYISSLFTPVDGGSPSLPNQAQLRRLCQVAAKGIWTMTYVFYRENLRRLGLTQSDVSSFMDSNIIQKDAEYENCYVFTHLHVQEFFAAMFYMLKGSWEAGNPSCQPFEDLKSLLQSTSYKDPHLTQMKCFLFGLLNEDRVKQLERTFNCKMSLKIKSKLLQCMEVLGNSDYSPSQLGFLELFHCLYETQDKAFISQAMRCFPKVAINICEKIHLLVSSFCLKHCRCLRTIRLSVTVVFEKKILKTSLPTNTWDGDRITHCWQDLCSVLHTNEHLRELDLYHSNLDKSAMNILHHELRHPNCKLQKLLLKFITFPDGCQDISTSLIHNKNLMHLDLKGSDIGDNGVKSLCEALKHPECKLQTLRLESCNLTVFCCLNISNALIRSQSLIFLNLSTNNLLDDGVQLLCEALRHPKCYLERLSLESCGLTEAGCEYLSLALISNKRLTHLCLADNVLGDGGVKLMSDALQHAQCTLKSLVLRRCHFTSLSSEYLSTSLLHNKSLTHLDLGSNWLQDNGVKLLCDVFRHPSCNLQDLELMGCVLTNACCLDLASVILNNPNLRSLDLGNNDLQDDGVKILCDALRYPNCNIQRLGLEYCGLTSLCCQDLSSALICNKRLIKMNLTQNTLGYEGIVKLYKVLKSPKCKLQVLGLCKEAFDEEAQKLLEAVGVSNPHLIIKPDCNYHNEEDVSWWWCF

SEQ ID NO: 14080 - protein, 994 aa, Homo sapiens
MAASFFSDFGLMWYLEELKKEEFRKFKEHLKQMTLQLELKQIPWTEVKKASREELANLLIKHYEEQQAWNITLRIFQKMDRKDLCMKVMRERTGYTKTYQAHAKQKFSRLWSSKSVTEIHLYFEEEVKQEECDHLDRLFAPKEAGKQPRTVIIQGPQGIGKTTLLMKLMMAWSDNKIFRDRFLYTFYFCCRELRELPPTSLADLISREWPDPAAPITEIVSQPERLLFVIDSFEELQGGLNEPDSDLCGDLMEKRPVQVLLSSLLRKKMLPEASLLIAIKPVCPKELRDQVTISEIYQPRGFNESDRLVYFCCFFKDPKRAMEAFNLVRESEQLFSICQIPLLCWILCTSLKQEMQKGKDLALTCQSTTSVYSSFVFNLFTPEGAEGPTPQTQHQLKALCSLAAEGMWTDTFEFCEDDLRRNGVVDADIPALLGTKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALVNCHLSPIDCEVLAGLLTNNKKLTYLNVSCNQLDTGVPLLCEALCSPDTVLVYLMLAFCHLSEQCCEYISEMLLRNKSVRYLDLSANVLKDEGLKTLCEALKHPDCCLDSLCLVKCFITAAGCEDLASALISNQNLKILQIGCNEIGDVGVQLLCRALTHTDCRLEILGLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 14081 - protein, 938 aa, Homo sapiens
MAASFFSDFGLMWYLEELKKEEFRKFKEHLKQMTLQLELKQIPWTEVKKASREELANLLIKHYEEQQAWNITLRIFQKMDRKDLCMKVMRERTGYTKTYQAHAKQKFSRLWSSKSVTEIHLYFEEEVKQEECDHLDRLFAPKEAGKQPRTVIIQGPQGIGKTTLLMKLMMAWSDNKIFRDRFLYTFYFCCRELRELPPTSLADLISREWPDPAAPITEIVSQPERLLFVIDSFEELQGGLNEPDSDLCGDLMEKRPVQVLLSSLLRKKMLPEASLLIAIKPVCPKELRDQVTISEIYQPRGFNESDRLVYFCCFFKDPKRAMEAFNLVRESEQLFSICQIPLLCWILCTSLKQEMQKGKDLALTCQSTTSVYSSFVFNLFTPEGAEGPTPQTQHQLKALCSLAAEGMWTDTFEFCEDDLRRNGVVDADIPALLGTKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALAFCHLSEQCCEYISEMLLRNKSVRYLDLSANVLKDEGLKTLCEALKHPDCCLDSLCLVKCFITAAGCEDLASALISNQNLKILQIGCNEIGDVGVQLLCRALTHTDCRLEILGLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 14082 - protein, 1037 aa, Homo sapiens; identical to SEQ ID NO: 14061

SEQ ID NO: 14083 - protein, 980 aa, Homo sapiens; identical to SEQ ID NO: 14043

SEQ ID NO: 14084 - protein, 672 aa, Homo sapiens
MTSPQLEWTLQTLLEQLNEDELKSFKSLLWAFPLEDVLQKTPWSEVEEADGKKLAEILVNTSSENWIRNATVNILEEMNLTELCKMAKAEMMEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQPHKPGLEYQPDSSWIVDSLSGIRESKL

SEQ ID NO: 14085 - protein, 1065 aa, Homo sapiens; identical to SEQ ID NO: 14045

SEQ ID NO: 14086 - protein, 1009 aa, Homo sapiens; identical to SEQ ID NO: 14044

SEQ ID NO: 14087 - protein, 275 aa, Homo sapiens
MEEVREGHALGGGMEADGPASLQELPPSPRSPSPPPSPPPLPSPPSLPSPAAPEAPELPEPAQPSEAHARQLLLEEWGPLSGGLELPQRLTWKLLLLRRPLYRNLLRSPNPEGINIYEPAPPTGPTQRPLETLGNFRGWYIRTEKLQQNQSWTVKQQCVDLLAEGLWEELLDDEQPAITVMDWFEDSRLDACVYELHVWLLAADRRTVIAQHHVAPRTSGRGPPGRWVQVSHVFRHYGPGVRFIHFLHKAKNRMEPGGLRRTRVTDSSVSVQLRE

SEQ ID NO: 14088 - protein, 470 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSLTGQSISTRTHTQPSPKEKEETAKSRSRCLHTALHIAEAPG

SEQ ID NO: 14089 - protein, 391 aa, Homo sapiens
MGLYAAAAGVLAGVESRQGSIKGLVYSSNFQNVKQLYALVCETQRYSAVLDAVIASAGLLRAEKKLRPHLAKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 14090 - protein, 340 aa, Homo sapiens
MLTQLKAKSEGKLAKQICKVVLDHFEKQYSKELGDAWNTVREILTSPSCWQYAVLLNRFNYPFELEKDLHLKGYHTLSQGSLPNYPKSVKCYLSRTPGRIPSERHQIGNLKKYYLLNAASLLPVLALELRDGEKVLDLCAAPGGKSIALLQCACPGYLHCNEYDSLRLRWLRQTLESFIPQPLINVIKVSELDGRKMGDAQPEMFDKVLVDAPCSNDRSWLFSSDSQKASCRISQRRNLPLLQIELLRSAIKALRPGGILVYSTCTLSKAENQDVISEILNSHGNIMPMDIKGIARTCSHDFTFAPTGQECGLLVIPDKGKAWGPMYVAKLKKSWSTGKW

SEQ ID NO: 14091 - protein, 384 aa, Homo sapiens
MAALTLRGVRELLKRVDLATVPRRHRYKKKWAATEPKFPAVRLALQNFDMTYSVQFGDLWPSIRVSLLSEQKYGALVNNFAAWDHVSAKLEQLSAKDFVNEAISHWELQSEGGQSAAPSPASWACSPNLRCFTFDRGDISRFPPARPGSLGVMEYYLMDAASLLPVLALGLQPGDIVLDLCAAPGGKTLALLQTGCCRNLAANDLSPSRIARLQKILHSYVPEEIRDGNQVRVTSWDGRKWGELEGDTYDRVLVDVPCTTDRHSLHEEENNIFKRSRKKERQILPVLQVQLLAAGLLATKPGGHVVYSTCSLSHLQNEYVVQGAIELLANQYSIQVQVEDLTHFRRVFMDTFCFFSSCQVGELVIPNLMANFGPMYFCKMRRLT

SEQ ID NO: 14092 - protein, 335 aa, Homo sapiens
MTYSVQFGDLWPSIRVSLLSEQKYGALVNNFAAWDHVSAKLEQLSAKDFVNEAISHWELQSEGGQSAAPSPASWACSPNLRCFTFDRGDISRFPPARPGSLGVMEYYLMDAASLLPVLALGLQPGDIVLDLCAAPGGKTLALLQTGCCRNLAANDLSPSRIARLQKILHSYVPEEIRDGNQVRVTSWDGRKWGELEGDTYDRVLVDVPCTTDRHSLHEEENNIFKRSRKKERQILPVLQVQLLAAGLLATKPGGHVVYSTCSLSHLQNEYVVQGAIELLANQYSIQVQVEDLTHFRRVFMDTFCFFSSCQVGELVIPNLMANFGPMYFCKMRRLT

SEQ ID NO: 14093 - protein, 335 aa, Homo sapiens; identical to SEQ ID NO: 14092

SEQ ID NO: 14094 - protein, 429 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 14095 - protein, 466 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 14096 - protein, 469 aa, Homo sapiens
MSIFPKISLRPEVENYLKEGFMNKEIVTALGKQEAERKFETLLKHLSHPPSFTTVRVNTHLASVQHVKNLLLDELQKQFNGLSVPILQHPDLQDVLLIPVIGPRKNIKKQQCEAIVGAQCGNAVLRGAHVYAPGIVSASQFMKAGDVISVYSDIKGKCKKGAKEFDGTKVFLGNGISELSRKEIFSGLPELKGMGIRMTEPVYLSPSFDSVLPRYLFLQNLPSALVSHVLNPQPGEKILDLCAAPGGKTTHIAALMHDQGEVIALDKIFNKVEKIKQNALLLGLNSIRAFCFDGTKAVKLDMVEDTEGEPPFLPESFDRILLDAPCSGMGQRPNMACTWSVKEVASYQPLQRKLFTAAVQLLKPEGVLVYSTCTITLAENEEQVAWALTKFPCLQLQPQEPQIGGEGMRGAGLSCEQLKQLQRFDPSAVPLPDTDMDSLREARREDMLRLANKDSIGFFIAKFVKCKST

SEQ ID NO: 14097 - protein, 718 aa, Homo sapiens
MLNSTGELEFSNEEDPEIISQLTSLPLSGGKSSAGVPEKTGYPDSVYVMAANIFQGIRIEKSAQKVLIKYGNEPLRSLSESEDQSFQRLSYELAFSALKYQDILETILIDSCIFPSTTIPDHLSSLIIVMLYDFQDRKFQTRVLSDNEEPISEVQEVENLLNSFKIKLAAALARCRIKHDALSIYHILPETVRKQELRASTLPLYAWINTCKISPEEVYNNLKRRGYNKVKSVLHIDDKVFAVDQHCYDVLIFPSHLKNDLINIDLFKDYKLIFQDKSRSLAVHSVKALLNMDDDVLMVNTGSWYTVSHMSILTNNNTSKVFVCGVQSQAKDPDLKTLFTKIGCKNIEILHEKFINIESKDHRLQKVKVILLLPRCSGLGVSNPVEFILNEHEDTEFLKDHSQGGISVDKLHVLAQQQYEQLTHAMKFTKAQAVVYCTCSVFPEENEAVVKKALEFQDLGNKGQPYRLSPPVLPLCSLKEIQLSTDKFFRMEPSEITNGCFLSILTRERDPSETVSVNDVLARAAAKGLLDGIELGKSSKREKKKKKSKTSLTKGATTDNGIQMKIAEFLNRETKASANLSETVTKPPLPQKNTAQVGASSQTRKPNKLAPHPAVPAFVKNTCPSRPRERQTHFLRPRPEDRMVALKPIKIVLPPVFMPFSSPQGIRSRMPTQHLYCRWVAPKALVPTCLPTHSLSRKEEKPKDDTPSSLLRPPRRWL

SEQ ID NO: 14098 - protein, 236 aa, Homo sapiens
MCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPETVRRGTELWERDREVWNGKEHDEN

SEQ ID NO: 14099 - protein, 114 aa, Homo sapiens
MSQAELSTCSAPQTQRIFQEAVRKGNTQELQSLLQNMTNCEFNVNSFGPEGQTALHQSVIDGNLELVKLLVKFGADIRLANRDGWSALHIAAFGGHQDIVLYLITKAKYAASGR

SEQ ID NO: 14100 - protein, 140 aa, Homo sapiens [sequence omitted]

SEQ ID NO: 14101 - protein, 533 aa, Homo sapiens
MISSSSVHSRTFNTSNALGPVCKHKKPLSAAKACISEILPSKFKPRLSAPSALLQEQKSILLPSEKAQSCENLCVSGSLNDSKRGLPLQVGGSIENLLMRSRRDYDSKSSSTMSLQEYSTSGRRPCPLSRKAGMQFTMLYRDMHQINRSGLFLGSISSSSSVRDLASHFEKSSLALSRGELGPSQEGSEHIPKHTVSSRITAFEQLIQRSRSMPSLDLSGRLSKSPTPVLSRGSLTSARSAESLLESTKLHPKEMDGMNSSGVYASPTCSNMAHHALSFRGLVPSEPLSTCSDDVDRCSNISTDSREGSGGSVHGDFPKHRLNKCKGTCPASYTRFTTIRKHEQQQTSRQPEWRLDARGDKSTLLRNIYLMSPLPFRLKKPLHHHPRQPSPGDSSGLLVGQKPDLPSQPHQDQPPSGGKPVVPTRLSSRHTMARLSRSSEPSQERPTALEDYPRAINNGNSVPYSDHSLDRNNNPQSELAPSRGGGILCVCLVSPARPSTLLALSRPPLCPWCSFSGLSFVFCLFCLAINHGS

SEQ ID NO: 14102 - protein, 1510 aa, Homo sapiens
MATRVEVGSITPLTAVPGLGEMGKEETLTRTYFLQAGEASGAPPARILEAKSPLRSPARLLPLPRLAPKPFSKEQDVKSPVPSLRPSSTGPSPSGGLSEEPAAKDLDNRMPGLVGQEVGSGEGPRTSSPLFNKAVFLRPSSSTMILFETTKSGPALGKAVSEGAEEAKLGVSGSRPEVAAKPALPTQKPAGTLPRSAPLSQDTKPPVPQEEAGQDHPPSKASSVEDTARPLVEPRPRLKRRPVSAIFTESIQPQKPGPGAAATVGKVPPTPPEKTWVRKPRPLSMDLTARFENKEALLRKVADEGSGPTAGDMAGLERPRAASKLDRDCLVKAEAPLHDPDLDFLEVAKKIRERKEKMLSKPEMGSPRALVGGSSGVTPSNDQSPWEEKAKLDPEPEKAAESPSPRLGRGLELAEVKSRVADGEAAAGGEWASRRSVRKCISLFREDSTLALAVGSESPLATPASPSAAPEPEKGVVSVQERIRGWTAESSEAKPEVRRRTFQARPLSADLTKLFSSSASSNEVKYEKSAELSGEFPKEPREKQKEGHSLDGACIPRSPWKPGTLRDKSRQTEQKVSSNQDPDSCRGGSSVEAPCPSDVTPEDDRSFQTVWATVFEHHVERHTVADQSGRCLSTTPPGDMAHARVSEPRPRPEMGSWLGRDPPDMTKLKKENSRGFDNPETEKLGPTTLLNGELRPYHTPLRDKYPLSENHNNNTFLKHLENPPTSQRIEPRYDIVHAVGERVHSEAISPAPEEKAVTLRSLRSWLSLKDRQLSQEVTPADLECGLEGQAGSVQRASLIWEARGMPEASGPKFGGNCPFPKWTGGAVVSSHKATVAVSEEHCAPGATSVRAIKAAIWESQHEGPEGARSKPGVGARGPPQGCPLDPLSRATNGPSDSQARTHPDAFAVQKGPFIVAAREGDPGPAQVPQPAVRMRKAGAMDQRMDRWRRRTLPPNVKFDTFSSLVPEDSPHVGHRRTDYVSPTASALRKPQLSHYRVETQEVNPGASRDQTSPAVKQGSPVEPKATFFAVTYQIPNTQKAKGVVLSGAESLLEHSRKITPPSSPHSLTSTLVSLGHEEALEMAGSKNWMKGREHENASILKTLKPTDRPSSLGAWSLDPFNGRIIDVDALWSHRGSEDGPRPQSNWKESANKMSPSGGAPQTTPTLRSRPKDLPVRRKTDVISDTFPGKIRDGYRSSVLDIDALMAEYQELSLKVPGEAQERRSPTVEPSTLPRERPVQLGGVEQRRRSLKEMPDTGGLWKPASSAEINHSFTPGLGKQLAETLETAMGTKSSPPFWALPPSAPSERYPGGSPIPADPRKKTGFAEDDRKAFASKHHVAKCQNYLAESKPSGREDPGSGVRVSPKSPPTDQKKGTPRKSTGRGEEDSVAQWGDHPRDCGRVPLDIKRAYSEKGPPANIREGLSIMHEARERRREQPKGRPSLTGENLEAKMGPCWWESGTGDSHKVLPRDLEKEDAPQEKERPLQQVSPVASVPWRSHSFCKDRRSGPFV

SEQ ID NO: 14103 - protein, 129 aa, Homo sapiens
  MOD_RES (1)..(1): Any amino acid
XISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVIPQMQKSN

SEQ ID NO: 14104 - protein, 180 aa, Homo sapiens
  MOD_RES (1)..(1): Any amino acid
XRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLGRSGPVDEGEPLVNADRRDSAVIGGVIAVEIFILLCITAIAIRIYQQRKLRKENESKVSKKEEC

SEQ ID NO: 14105 - protein, 290 aa, Homo sapiens
  MOD_RES (1)..(1): Any amino acid
XISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSAVIGGVIAVEIFILLCITAIAIRIYQQRKLRKENESKVSKKEEC

SEQ ID NO: 14106 - protein, 90 aa, Homo sapiens
MWHYIGAAECPYLQLPRCRGSSTRYWHKKSRGRLTWPWLLMSQLRTCHINSPFPLAVTCGVKFSEAAVPVHLSGCVQKMNICLQLQFSND

SEQ ID NO: 14107 - protein, 103 aa, Homo sapiens
MPLEKFVDMEFLDQMILRGTCLEADLCPQYTNSPFNAHTDQITQTHLPPQHLDSSHSTHTCLPVHRHIQRHTDKHHSKKMFPRTHGHPNPRIIRLSQRHVCTA

SEQ ID NO: 14108 - protein, 61 aa, Homo sapiens
MEASLGGPEPNGVINEEAKAGATGKRRGRAPANGGRASGENRAFPVLQLPGNWHCRRRQGC

SEQ ID NO: 14109 - protein, 113 aa, Homo sapiens
MGSPFYCNGGYWLQRTECWRTMNEFHFRSAQLAVPGRQPQELFRRHRATSAWSSRRRSALVVGTIGPGHGRLQDPSCTKLPSPPAWFPFFMNRSMGHSQVGMHVFHRMGTTSS

SEQ ID NO: 14110 - protein, 259 aa, Homo sapiens
MTINMLNVFGNEDFDCHGDLKTDQLKMDILIKKLKQKFDDLTAEKEALSSKCVNLAKDNQVLQQEFLSMKKVQQQCEKLEEDKKMLKEEILNLKTHMENNRVELSKLQEYKLELDEKAMQAVEKLEEIHLQEQAQYEKQLEQLSKDNMASLNKKELTLKDVECKFSEMKTAYEEVTTELEEYKEAFAAALKANNSMSKKLTKSNKKIAVISMKLLMEKEQMKYFLSALPTRRDPESPCVENLTSIGLNRKYIPQTPIRI

SEQ ID NO: 14111 - protein, 172 aa, Homo sapiens
  MOD_RES (1)..(1): Any amino acid
XYKKLLEMTINMLNVFGNEDFDCHGDLKTDQLKMDILIKKLKQKEQAQYEKQLEQLSKDNMASLNKKELTLKDVECKFSEMKTAYEEVTTELEEYKEAFAAALKANNSMSKKLTKSNKKIAVISMKLLMEKEQMKYFLSALPTRRDPESPCVENLTSIGLNRKYIPQTPIRI

SEQ ID NO: 14112 - protein, 533 aa, Homo sapiens
MSQTSLKQKKNEPGMRSSKESLEAEKRKESDKTGVRLSNQGSQESSLRKTDSRGYLVRSQWSRISRSPSTKAPSIDEPRSRNTSAKVELPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQEEPRLDVLINNAGIFQCPYMKTEDGFEMQFGVNHLGHFLLTNLLLGLLKSSAPSRIVVVSSKLYKYGDINFDDLNSEQSYNKSFCYSR

SEQ ID NO: 14113 - protein, 602 aa, Homo sapiens
MSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRKSLGWMS

SEQ ID NO: 14114 - protein, 628 aa, Homo sapiens
MESLVFARRSGPTPSAAELARPLAEGLIKSPKPLMKKQAVKRHHHKHNLRHRYEFLETLGKGTYGKVKKARESSGRLVAIKSIRKDKIKDEQDLMHIRREIEIMSSLNHPHIIAIHEVFENSSKIVIVMEYASRGDLYDYISERQQLSEREARHFFRQIVSAVHYCHQNRVVHRDLKLENILLDANGNIKIADFGLSNLYHQGKFLQTFCGSPLYASPEIVNGKPYTGPEVDSWSLGVLLYILVHGTMPFDGHDHKILVKQISNGAYREPPKPSDACGLIRWLLMVNPTRRATLEDVASHWWVNWGYATRVGEQEAPHEGGHPGSDSARASMADWLRRSSRPLLENGAKVCSFFKQHAPGGGSTTPGLERQHSLKKSRKENDMAQSLHSDTADDTAHRPGKSNLKLPKGILKKKVSASAEGVQEDPPELSPIPASPGQAAPLLPKKGILKKPRQRESGYYSSPEPSESGELLDAGDVFVSGDPKEQKPPQASGLLLHRKGILKLNGKFSQTALELAAPTTFGSLDELAPPRPLARASRPSGAVSEDSILSSESFDQLDLPERLPEPPLRGCVSVDNLTGLEEPPSEGPGSCLRRWRQDPLGDSCFSLTDCQEVTATYRQALRVCSKLT

SEQ ID NO: 14115 - protein, 153 aa, Homo sapiens
MSKDLKILCKDPALELSCYRDHQFSGRKFQQEKLLKESSTLNMGNLSFYTTEEKIHELFSRSDIRNIFMGLDKIKKTACGFCFVECHNRADAENAMRFLTGTCLDEWIICTDWDVGFREGQQYGRGKSGGQVRDEFREDFHSGRGGFGRQTQI

SEQ ID NO: 14116 - protein, 276 aa, Homo sapiens
MPKTCQCYVGTKTTNPSAWPSREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 14117 - protein, 782 aa, Homo sapiens
MDSRVMSKWMKNLKLKGYIIQKREIKPSLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPEGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYK

SEQ ID NO: 14118 - protein, 1034 aa, Homo sapiens
MKSRFSTIDLRAVLAELNASLLGMRVNNVYDVDNKTYLIRLQKPDFKATLLLESGIRIHTTEFEWPKNMMPSSFAMKGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPSLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 14119 - protein, 1055 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPSLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 14120 - protein, 460 aa, Homo sapiens
MAFQTQAGAQIPIERLASERAITVKVPNNSDWAARGHRSSANSVVVQPQASVGAVVTLDSSNPAAVLHLQLNYTLLDGRYLSEEPEPYLAVYLHSEPRPNEHNCSASRRIRPESLQGADHRPYTFFISPGTRDPVGSYRLNLSSHFRLSALEVSVGLYTSLCQYFSEEDVVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYESSSRQAGAGAQVPRPTWASCCMGWTAGAATGTWMATEPSTATAWTSSGSPPRTAWVACGRSECGTTKGSALPGSCSTSSSGTCRRHTAPSSWSMTGFRWRRRPTGAWWRRRCWPRVTQPCCASGACWWLSCSAASLTSTSGSPYGTGRLVAVSLASRGPPAAFSSSASSWAPTPCGTGLLVTLPTARGMCPG

SEQ ID NO: 14121 - protein, 443 aa, Homo sapiens
MRLRFWLLIWLLLGFISHQPTPVINSLAVYRHRETDFGVGVRDHPGQHGKTPSPQKLDNLIIIIIGFLRRDTFTILFCTSYLCVSFLKTIFWSRNGHDGSTDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPCWPYLTAEALKNRMGRQPPPPTQQHSITDNSLSLKTPPECLLHPLPPSVDDNIKECPLAPLPPSVDDNLKEYLLVPLPPSPLPPSVDDNLKDCLFVPLPPSPLPPSVDDNLKTPPLATQEAEAEKPPKPKRWRVDEVEQSPKPKRRRADEVEQSPKPKRQREAEAQQLPKPKRRRLSKLRTRHCTQAWAIRINPWVEKKKKIKKQNKTHAPKTN

SEQ ID NO: 14122 - protein, 660 aa, Homo sapiens
MFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAFHPQRMISRHLPSVSSLPFHPQLHPQQMIISRYLLSVCGFRFHHQPMIISRHLPSVSSLPFHPQLHPQQMIISRHLLSVCGGRFHPERMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 14123 - protein, 1062 aa, Homo sapiens
MHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERPLPPSAPPSADDNIKTPAERLRGPLPPSADDNLKTPSERHIMPFPSADDNINTPAERLRGPLPPSADDNLKTPSERQLTPLPPSAPPSADDNIKTPAERLRGPLPPSADDNLKTPSERQLTPLPPSAPPSADDNIKTPAFHPQRMISRHLPSVSSLPFHPQLHPQQMIISRYLLSVCGFRFHHQPMIISRHLPSVSSLPFHPQLHPQQMIISRHLLSVCGGRFHPERMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSLPEPKRRRLS

SEQ ID NO: 14124 - protein, 848 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECLLTPLPPSALPSAPPSADDNLKTRAECLLHPLPPSADDNLKTPSERQLTPLPPSAPPSADDNIKTPAFHPQRMIISRHLPSVSSLPFHPQLHPQQMIISRHLPSVCGGRFHPQPMIISRHLPSVSSLPFHPQLHPQQMIISRHLLSVCGGRFHPERMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 14125 - protein, 982 aa, Homo sapiens
MFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERRTPLPPSAPPSADDNIKTPAERLRGPLPPSADDNLKTPSERHIMPPPSADDNINTPAERLRGPLPPSADDNLKTPSERQLTPLPPSADDNIKTPAERLRGPLPPSADDNLKTPSERQLTPLPPSAPPSADDNIKIPAERLRIPLPPSADDNLKTPSERQLTPLPPSAPPSADDNIKTPGFHPERMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 14126 - protein, 420 aa, Homo sapiens
MAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 14127 - protein, 153 aa, Homo sapiens
MAAVEHRHSSGLPYWPYLTAETLKNRMGHQPPPPTQQHSIIDNSLSLKTPSECVLYPLPPSADDNLKTPPECLLTPLPPSALPSADDNLKTPAECLLYPLPPSADDNLKTPPECLLTPLPPSAPPSADDNLKTPPECVCSLPFHPQRMIISRN

SEQ ID NO: 14128 - protein, 175 aa, Homo sapiens
MKVTTKVNRHDKINGKRKTAKEHLRKLSMKEREHREEERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNCVAQKHLHPHPVGPPSNILSVRGSVFVIANGP

SEQ ID NO: 14129 - protein, 353 aa, Homo sapiens
MRLRFWLLIWLLLGFISHQPTPVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 14130 - protein, 97 aa, Homo sapiens
MEAPAERALPRLQALARPPPPISYEEELYDCLDYYYLRDFPACGAGRSKGRTRREQALRTNWPAPGGHERKVAQKLLNGQRKRRQRQLHPKMRTRLT

SEQ ID NO: 14131 - protein, 614 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 14132 - protein, 614 aa, Homo sapiens; identical to SEQ ID NO: 14131

SEQ ID NO: 14133 - protein, 614 aa, Homo sapiens; identical to SEQ ID NO: 14131

SEQ ID NO: 14134 - protein, 402 aa, Homo sapiens
MPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 14135 - protein, 387 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 14136 - protein, 387 aa, Homo sapiens; identical to SEQ ID NO: 14135

SEQ ID NO: 14137 - protein, 202 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQI

SEQ ID NO: 14138 - protein, 68 aa, Homo sapiens
MSLWLGAPVPDIPPDSAVELWKPGAQDASSQAQGGSSCILREEARMPHSAGGTAGVGLEAAEPTALLT

SEQ ID NO: 14139 - protein, 447 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 14140 - protein, 194 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPP

SEQ ID NO: 14141 - protein, 205 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQ

SEQ ID NO: 14142 - protein, 77 aa, Homo sapiens
MSLWLGAPVPDIPPDSAVELWKPGAQDASSQAQGGSSCILREEARMPHSAGGTAGVGLEAAEPTALLTRAEPPSEPT

SEQ ID NO: 14143 - protein, 447 aa, Homo sapiens; identical to SEQ ID NO: 14139

SEQ ID NO: 14144 - protein, 626 aa, Homo sapiens
MCSTLKKCGTYRTEVAECHDHGSTFQGRKKGGSSFRDNFDKRSCHYEHGGYERPPSHCQENDGSVEMRDVHKDQQLRHTPYSIRCERRMKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTERMLCFSVNGVFKEVEGQSQGSVLAFTRTFIATPGSSSSLCIVNDELFVRDASPQETQSAFSIPVSTLSSSSEPSLSQEQQEMVQAFSAQSGMKLEWSQKCLQDNEWNYTRAGQAFTMLQTEGKIPAEAFKQIS

SEQ ID NO: 14145 - protein, 626 aa, Homo sapiens; identical to SEQ ID NO: 14144

SEQ ID NO: 14146 - protein, 156 aa, Homo sapiens
MVDILGERHLVTCKGATVEAEAALQNKVVALYFAAARCAPSRDFTPLLCDFYTALVAEARRPAPFEVVFVSADGSSQEMLDFMRELHGAWLALPFHDPYRHELRKRYNVTAIPKLVIVKQNGEVITNKGRKQIRERGLACFQDWVEAADIFQNFSV

SEQ ID NO: 14147 - protein, 135 aa, Homo sapiens
MVDILGERHLVTCKGATVEAEAALQNKVVALYFAAARCAPSRDFTPLLCDFYTALVAEARRPAPFEVVFVSADGSSQEMLDFMRELHGAWLALPFHDPYRQRSLALLPRLECSGVILAHCNLCLLGSSDSLALAS

SEQ ID NO: 14148 - protein, 228 aa, Homo sapiens
MARHVFLTGPPGVGKTTLIHKASEVLKSSGVPVDGFYTEEVRQGGRRIGFDVVTLSGTRGPLSRVGLEPPPGKRECRVGQYVVDLTSFEQLALPVLRNADCSSGPGQRVCVIDEIGKMELFSQLFIQAVRQTLSTPGTIILGTIPVPKGKPLALVEEIRNRKDVKVFNSPYCVIEDQSKFSSCVSQSTLTEPGWRQKLLQSLLNSEWKKRAPVVPTSVSPPFYLRWIP

SEQ ID NO: 14149 - protein, 190 aa, Homo sapiens
MARHVFLTGPPGVGKTTLIHKASEVLKSSGVPVDGFYTEEVRQGGRRIGFDVVTLSGTRGPLSRVGLEPPPGKRECRVGQYVVDLTSFEQLALPVLRNADCSSGPGQRVCVIDEIGKMELFSQLFIQAVRQTLSTPGTIILGTIPVPKGKPLALVEEIRNRKDVKVFNVTKENRNHLLPDIVTCVQSSRK

SEQ ID NO: 14150 - protein, 107 aa, Homo sapiens
MMEGLGEHSTAGEMGPLLGAVAATASPQSLMEYSSDADFIESLPLVVKYRVYTLKKLQAKCAVLEAKYLREFHSVERKFATIYGPLLEKRRQITNALYEPTKEECER

SEQ ID NO: 14151 - protein, 1013 aa, Homo sapiens
MCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLPIFTPSQRARRLLDLATVKANGLAAFLLQHVQELPVPLALPLEAATCKKYMAKLRTTVSAQSRFLSTYDGAETLCLEDIYTENVLEVWADVGMAGPPQKSPATLGLEELFSTPGHLNDDADTVLVVGEAGSGKSTLLQRLHLLWAAGQDFQEFLFVFPFSCRQLQCMAKPLSVRTLLFEHCCWPDVGQEDIFQLLLDHPDRVLLTFDGFDEFKFRFTDRERHCSPTDPTSVQTLLFNLLQGNLLKNARKVVTSRPAAVSAFLRKYIRTEFNLKGFSEQGIELYLRKRHHEPGVADRLIRLLQETSALHGLCHLPVFSWMVSKCHQELLLQEGGSPKTTTDMYLLILQHFLLHATPPDSASQGLGPSLLRGRLPTLLHLGRLALWGLGMCCYVFSAQQLQAAQVSPDDISLGFLVRAKGVVPGSTAPLEFLHITFQCFFAAFYLALSADVPPALLRHLFNCGRPGNSPMARLLPTMCIQASEGKDSSVAALLQKAEPHNLQITAAFLAGLLSREHWGLLAECQTSEKALLRRQACARWCLARSLRKHFHSIPPAAPGEAKSVHAMPGFIWLIRSLYEMQEERLARKAARGLNVGHLKLTFCSVGPTECAALAFVLQHLRRPVALQLDYNSVGDIGVEQLLPCLGVCKALYLRDNNISDRGICKLIECALHCEQLQKLALFNNKLTDGCAHSMAKLLACRQNFLALRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 14152 - protein, 146 aa, Homo sapiens
MCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLP

SEQ ID NO: 14153 - protein, 583 aa, Homo sapiens
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSLTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 14154 - protein, 554 aa, Homo sapiens
MLYLQGWSMPAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSLTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 14155 - protein, 157 aa, Homo sapiens
MSAPFEERSGVVPCGTPWGQWYQTLEEVFIEVQVPPGTRAQDIQCGLQSRHVALSVGGREILKGKLFDSTIADEGTWTLEDRKMVRIVLTKTKRDAANCWTSLLESEYAADPWVQDQMQRKLTLERFQKENPGFDFSGAEISGNYTKGGPDFSNLEK

SEQ ID NO: 14156 - protein, 361 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 14157 - protein, 164 aa, Homo sapiens
MKCKPNQTRTYDPEGFKKRAACLCFRSEREDEVLLVSSSRYPDRWIVPGGGMEPEEEPGGAAVREVYEEAGVKGKLGRLLGVFEQNQDPKHRTYVYVLTVTELLEDWEDSVSIGRKREWFKVEDAIKVLQCHKPVHAEYLEKLKLGGSPTNGNSMAPSSPDSDP

SEQ ID NO: 14158 - protein, 164 aa, Homo sapiens [sequence omitted]

SEQ ID NO: 14159 - protein, 328 aa, Homo sapiens
MAEVRVQLLLSRRPESVSFARSVCGLLGAGPGLGTWPIHCSLKRGRLVLSSRPFPGASARLPLQRPPFCPFAALEERPRVPGAELPTDRGVDLGVAVILQSSDKTVLLTRRARTLSVSPNLWVPPGGHVELEEELLDGGLRELWEESGLHLPQGQFSWVPLGLWESAYPPRLSWGLPKYHHIVLYLLVISQESQQQLQARIQPNPNEVSALMWLTPDVAAAVAAAEDGTETPGLLPQDLPPSVLAVELEEDGRARPLVLHMSTLLRMIPTMAEDKERVSTGTKFALKLWLQHLGRTPPPCKSAAYLDPGPAKEEWNMDPLPPNQGSGK

SEQ ID NO: 14160 - protein, 184 aa, Homo sapiens
  MOD_RES (1)..(1): Any amino acid
XAVILQSSDKTVLLTRRARTLSVSPNLWVPPGGLRELWEESGLHLPQGQFSWVPLGLWESAYPPRLSWGLPKYHHIVLYLLVISQESQQQLQARIQPNPNEVSALMWLTPDVAAAVAAAEDGTETPGLLPRTRGGWKSPTSGPAHVHPPADDPNHGRGQRESQHWNQVCPQALAATSGQNTPTV

SEQ ID NO: 14161 - protein, 323 aa, Homo sapiens
MASEGLAGALASVLAGQGSSVHSCDSAPAGEPPAPVRLRKNVCYVVLAVFLSEQDEVLLIQEAKRECRGSWYLPAGRMEPGETIVEALQREVKEEAGLHCEPETLLSVEERGPSWVRFVFLARPTGGILKTSKEADAESLQAAWYPRTSLPTPLRAHDILHLVELAAQYRQQARHPLILPQELPCDLVCQRLVATFTSAQTVWVLVGTVGMPHLPVTACGLDPMEQRGGMKMAVLRLLQECLTLHHLVVEIKGLLGLQHLGRDHSDGICLNVLVTVAFRSPGIQDEPPKVRGENFSWWKVMEEDLQSQLLQRLQGSSVVPVNR

SEQ ID NO: 14162 - protein, 59 aa, Homo sapiens
MASEGLAGALASVLAGQGSSVHSCDSAPAGEPPAPRAGCGRTCATWCWPCSSASRMRCY

SEQ ID NO: 14163 - protein, 246 aa, Homo sapiens
MEPGETIVEALQREVKEEAGLHCEPETLLSVEERGPSWVRFVFLARPTGGILKTSKEADAESLQAAWYPRTSLPTPLRAHDILHLVELAAQYRQQARHPLILPQELPCDLVCQRLVATFTSAQTVWVLVGTVGMPHLPVTACGLDPMEQRGGMKMAVLRLLQECLTLHHLVVEIKGLLGLQHLGRDHSDGICLNVLVTVAFRSPGIQDEPPKVRGENFSWWKVMEEDLQSQLLQRLQGSSVVPVNR

SEQ ID NO: 14164 - protein, 375 aa, Homo sapiens
MSSSLRPGPSRWRRAASIVLAAGWSRPETATPPSRPPPAEGFRLLLLQRSPHQGFMPGAHVFSGGVLDAADRSADWLGLFAPHHGPPRFGLGPAPFSRTAFPSLPDTDDHKTDNTGTLPEDVAFRICAVREAFEEAGVLLLRPRTSPPGPAPGPGLALEPPPGLASWRDRVRQDPRHFLRLCAHLDCTPDIWALHNWSAWLTPFLRGTTRRFDTAFFLCCLREPPPVYPDLAEVVGYQWSSPSEATESFLSKEIWLPPPQFYEVRRLANFASLSDLHKFCLGRALEGLERWLPIILLTADGMVHLLPGDELYLEDSDFLENLMSTEKKTEEIMKEGKQFHRIVTYHRHLYDIHVTVQPKYKHVYPKNSVVRKSHL

SEQ ID NO: 14165 - protein, 303 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQALCPGGSPQHQDLAGQLVVHELFSSVLQEICDEVNLPLLTLSQPLLLGIARNETSAGRASAEFYVQCSLTSEQVRKHYLSGGPEAHESTGIFFVETQNVQRLLETEMWAELCPSAKGAIILYNRVQGSPTGAALGSPALLPPL

SEQ ID NO: 14166 - protein, 270 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQVNLPLLTLSQPLLLGIARNETSAGRASAEFYVQCSLTSEQVRKHYLSGGPEAHESTGIFFVETQNVQRLLETEMWAELCPSAKGAIILYNRVQGSPTGAALGSPALLPPL

SEQ ID NO: 14167 - protein, 212 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQVRFQAGHKDPDSSRELQLSTLPILPALVSSLKGKLAWYFSGSLLRAVHLPPH

SEQ ID NO: 14168 - protein, 124 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVG

SEQ ID NO: 14169 - protein, 181 aa, Homo sapiens
MMKFKPNQTRTYDREGFKKRAACLCFRSEQEDEVLLVSSSRYPDQWIVPGGGMEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 14170 - protein, 180 aa, Homo sapiens
MMKFKPNQTRTYDREGFKKRAACLCFRSEQEDEVLLVSSSRYPDQWIVPGGGMEPEEEPGGAAVREVYEEAGVKGKLGRLLGIFENQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 14171 - protein, 129 aa, Homo sapiens
MEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 14172 - protein, 180 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGGMFCNSWWPSVYDLV

SEQ ID NO: 14173 - protein, 232 aa, Homo sapiens
MESQEPTESSQNGKQYIISEELISEGKWVKLEKTTYMDPTGKTRRNKEKTTTLLILRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 14174 - protein, 186 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDETL

SEQ ID NO: 14175 - protein, 98 aa, Homo sapiens [sequence omitted]

SEQ ID NO: 14176 - protein, 219 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 14177 - protein, 219 aa, Homo sapiens; identical to SEQ ID NO: 14176

SEQ ID NO: 14178 - protein, 238 aa, Homo sapiens
MSRLGLPEEPVRNSLLDDAKARLRKYDIGGKYSHLPYNKYSVLLPLVAKEGKLHLLFTVRSEKLRRAPGEVCFPGGKRDPTDMDDAATALREAQEEVGLRPHQVEVVCCLVPCLIDTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 14179 - protein, 185 aa, Homo sapiens
MSRLGLPEEPVRNSLLDDAKARLRKYDIGGKYSHLPYNKYSVLLPLVAKEGKLHLLFTVRSEKTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 14180 - protein, 170 aa, Homo sapiens
MSRLGLPEEPVRNSLLDDAKARLRKYDIGGKYSHLPYNKYSVLLPLVAKEGKLHLLFTVRSEKLRRAPGEVCFPGGKRDPTDMDDAATALREAQEEVGLRPHQVEVVCCLVPCLIDRWGSRYVDEAGLELLASSDPPTSASQSAGITDRYIDNSICGFNRPQLPGPAESC

SEQ ID NO: 14181 - protein, 273 aa, Homo sapiens
MRLPGVPLARPALLLLLPLLAPLLGTGAPAELRVRVRLPDGQVTEESLQADSDADSISLELRKPDGTLVSFTADFKKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDHGKPCVCRYGLSLAWYPCMLKYCHSRDRPTPYKCGIRSCQKSYSFDFYVPQRQLCLWDEDPYPG

SEQ ID NO: 14182 - protein, 264 aa, Homo sapiens
MHNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMDPGFLDKQARCHYLKGKLRHLKTQIQKFDDQGDSEGSVYF

SEQ ID NO: 14183 - protein, 44 aa, Homo sapiens
MGMYPPLLLKIYLSRHISILFYLKILYKSGIIWLSWYSFILLVL

SEQ ID NO: 14184 - protein, 318 aa, Homo sapiens
MERGDQPKRTRNENIFNCLYKNPEATFKLICFPWMGGGSTHFAKWGQDTHDLLEETASHHVAKAGLKLRRSSDPPASAYPCAGVSHRRREPPCLAKILGLFWILIFFMHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 14185 - protein, 137 aa, Homo sapiens
MERGDQPKRTRQATPCATRLFLHPRGSDTLPLNENIFNCLYKNPEATFKLICFPWMGGGSTHFAKWGQDTHDLLEVHSLRLPGRESRVEEPLENDISQLVDEVVCALQPVIQDKPFAFFGHRYLISVLKDFRGVSSI

SEQ ID NO: 14186 - protein, 265 aa, Homo sapiens
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 14187 - protein, 96 aa, Homo sapiens
MERGDQPKRTRNENIFNCLYKNPEATFKLICFPWMGGGSTHFAKWGQDTHDLLEETASHHVAKAGLKLRRSSDPPASAYPCAGVSHRRREPPCLAK

SEQ ID NO: 14188 - protein, 143 aa, Homo sapiens
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPK

SEQ ID NO: 14189 - protein, 181 aa, Homo sapiens
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIR

SEQ ID NO: 14190 - protein, 318 aa, Homo sapiens
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKSIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGT

SEQ ID NO: 14191 - protein, 328 aa, Homo sapiens
MKLWMESHLIVPETRPSPRMMSNQTLVTEFILQGFSEHPEYRVFLFSCFLFLYSGALTGNVLITLAITFNPGLHAPMYFFLLNLATMDIICTSSIMPKALASLVSEESSISYGGCMAQLYFLTWAASSELLLLTVMAYDRYAAICHPLHYSSMMSKVFCSGLATAVWLLCAVNTAIHTGLMLRLDFCGPNVIIHFFCEVPPLLLLSCSSTYVNGVMIVLADAFYGIVNFLMTIASYGFIVSSILKVKTAWGRQKAFSTCSSHLTVVCMYYTAVFYAYISPVSGYSAGKSKLAGLLYTVLSPTLNPLIYTLRNKEVKAALRKLFPFFRN

SEQ ID NO: 14192 - protein, 300 aa, Homo sapiens
MGQNQTSISDFLLLGLPIQPEQQNLCYALFLAMYLTTLLGNLLIIVLIRLDSHLHTPVYLFLSNLSFSDLCFSSVTMPKLLQNMQNQDPSIPYADCLTQMYFFLYFSDLESFLLVAMAYDRYVAICFPMHYTAIMSPMLCLSVVALSWVLTTFHAMLHTLLMARLCFCADNVIPHFFCDMSALLKLACSDTRVNEWVIFIMGGLILVIPFLLILGSYARIVSSILKVPSSKGICKAFSTCGSHLSVVSLFYGTVIGLYLCPSANSSTLKDTVMAMMYTVVTPMLTPFIYSLRNRDMKGAL

SEQ ID NO: 14193 - protein, 315 aa, Homo sapiens
MEIVSTGNETITEFVLLGFYDIPELHFLFFIVFTAVYVFIIIGNMLIIVAVVSSQRLHKPMYIFLANLSFLDILYTSAVMPKMLEGFLQEATISVAGCLLQFFIFGSLATAECLLLAVMAYDRYLAICYPLHYPLLMGPRRYMGLVVTTWLSGFVVDGLVVALVTQLRFCGPNHIDQFYCDFMLFVGLACSDPRVAQVTTLILSVFCLTIPFGLILTSYARIVVAVLRVPAGASRRRAFSTCSSHLAVVTTFYGTLMIFYVAPSAVHSQLLSKVFSLLYTVVTPLFNPVIYTMRNKEVHQALRKILCIKQTETLD

SEQ ID NO: 14194 - protein, 315 aa, Homo sapiens; identical to SEQ ID NO: 14193

SEQ ID NO: 14195 - protein, 315 aa, Homo sapiens; identical to SEQ ID NO: 14193

SEQ ID NO: 14196 - protein, 307 aa, Homo sapiens
MLNTTSVTEFLLLGVTDIQELQPFLFVVFLTIYFISVTGNGAVLMIVISDPRLHSLMYFFLGNLSYLDICYSTVTLPKMLQNFLSTHKAISFLGCISQLHFFHFLGSTESMLFAVMAFDLSVAICKPLRYTVIMNPQLCTQMAITIWVIGFFHALLHSVMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 14197 - protein, 307 aa, Homo sapiens; identical to SEQ ID NO: 14196

SEQ ID NO: 14198 - protein, 307 aa, Homo sapiens; identical to SEQ ID NO: 14196

SEQ ID NO: 14199 - protein, 316 aa, Homo sapiens
MENVTTMNEFLLLGLTGVQELQPFFFGIFLIIYLINLIGNGSILVMVVLEPQLHSPMYFFLGNLSCLDISYSSVTLPKLLVNLVCSRRAISFLGCIIQLHFFHFLGSTEAILLAIMAFDRFVAICNPLRYTVIMNPQVCILLAAAAWLISFFYALMHSVMTAHLSFCGSQKLNHFFYDVKPLLELACSDTLLNQWLLSIVTGSISMGAFFLTLLSCFYVIGFLLFKNRSCRILHKALSTCASHFMVVCLFYGPVGFTYIRPASATSMIQDRIMAIMYSAVTPVLNPLIYTLRNKEVMMALKKIFGRKLFKDWQQHH

SEQ ID NO: 14200 - protein, 316 aa, Homo sapiens; identical to SEQ ID NO: 14199

SEQ ID NO: 14201 - protein, 316 aa, Homo sapiens; identical to SEQ ID NO: 14199

SEQ ID NO: 14202 - protein, 316 aa, Homo sapiens; identical to SEQ ID NO: 14199

SEQ ID NO: 14203 - protein, 311 aa, Homo sapiens
MDNLTKVTEFLLMEFSGIWELQVLHAGLFLLIYLAVLVGNLLIIAVITLDQHLHTPMYFFLKNLSVLDLCYISVTVPKSIRNSLTRRSSISYLGCVAQVYFFSAFASAELAFLTVMSYDRYVAICHPLQYRAVMTSGGCYQMAVTTWLSCFSYAAVHTGNMFREHVCRSSVIHQFFRDIPHVLALVSCEVFFVEFLTLALSSCLVLGCFILMMISYFQIFSTVLRIPSGQSRAKAFSTCSPQLIVIMLFLTTGLFAALGPIAKALSIQDLVIALTYTVLPPFLNPIIYSLRNKEIKTAMWRLFVKIYFLQK

SEQ ID NO: 14204 - protein, 321 aa, Homo sapiens
MVNLTSTSGFLLMGFSDERKLQILHALVFLVTYLLALTGNLLIITIITVDRRLHSPMYYFLKHLSLLDLCFISVTVPQSIANSLMGNGYISLVQCILQVFFFIALASSEVAILTVMSYDRYAAICQPLHYETIMDPRACRHAVIAVWIAGGLSGLMHAAINFSIPLCGKRVIHQFFCDVPQMLKLACSYEFINEIALAAFTTSAAFICLISIVLSYIRIFSTVLRIPSAEGRTKVFSTCLPHLFVATFFLSAAGFEFLRLPSDSSSTVDLVFSVFYTVIPPTLNPVIYSLRNDSMKAALRKMLSKEELPQRKMCLKAMFKL

SEQ ID NO: 14205 - protein, 321 aa, Homo sapiens; identical to SEQ ID NO: 14204

SEQ ID NO: 14206 - protein, 321 aa, Homo sapiens; identical to SEQ ID NO: 14204

SEQ ID NO: 14207 - protein, 321 aa, Homo sapiens; identical to SEQ ID NO: 14204

SEQ ID NO: 14208 - protein, 312 aa, Homo sapiens
MVNQSSTPGFLLLGFSEHPGLERTLFVVVFTSYLLTLVGNTLIILLSVLDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 14209 - protein, 312 aa, Homo sapiens
MVNQSSTPGFLLLGFSEHPGLERTLFVVVFTSYLLTLVGNTLIILLSALDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 14210 - protein, 312 aa, Homo sapiens; identical to SEQ ID NO: 14208

SEQ ID NO: 14211 - protein, 312 aa, Homo sapiens; identical to SEQ ID NO: 14208

SEQ ID NO: 14212 - protein, 312 aa, Homo sapiens
MLMKKNASFEDFFILLGFSNWPHLEVVLFVVILIFYLITLIGNLFIIILSYLDSHLHTPMYFFLSNLSFLDLCYTTSSIPQLLVNLWGPEKTISYAGCTVQLYFVLALGTAECVLLVVMSYDRYAAVCRPLHYTVLMHPRFCRLLAAASWVSGFTTSALHSSFTFWIPLCRHRLVDHFFCEVPALLRLSCVDTQANELTLMVMSSIFVLIPLILILTSYGAIARAVLSMQSTTGLQKVLRTCGAHLMVVSLFFIPVMCMYLQPPSENSQDQGKFIALFYTVVTPSLNPLIYTFRNKDVRGAVKRLMGWEWGM

SEQ ID NO: 14213 - protein, 312 aa, Homo sapiens
MMIKKNASSEDFFILLGFSNWPQLEVVLFVVILIFYLMTLTGNLFIIILSYVDSHLHTPMYFFLSNLSFLDLCYTTSSIPQLLVNLRGPEKTISYAGCMVQLYFVLALGIAECVLLVVMSYDRYVAVCRPLHYTVLMHPRFCHLLVAASWVIGFTISALHSSFTFWVPLCGHRLVDHFFCEVPALLRLSCVDTHANELTLMVMSSIFVLIPLILILTTYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 14214 - protein, 312 aa, Homo sapiens
MMIKKNASSEDFFILLGFSNWPQLEVVLFVVILIFYLMTLTGNLFIIILSYVDSHLHTPMYFFLSNLSFLDLCYTTSSIPQLLVNLRGPEKTISYAGCMVQLYFVLALGITECVLLVVMSYDRYVAVCRPLHYTVLMHPRFCHLLVAASWVIGFTISALHSSFTFWVPLCGHRLVDHFFCEVPALLRLSCVDTHANELTLMVMSSIFVLIPLILILTTYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 14215 - protein, 312 aa, Homo sapiens; identical to SEQ ID NO: 14213

SEQ ID NO: 14216 - protein, 311 aa, Homo sapiens
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVRAILRMQSTTGLQKVFGTCGAHLMAVSLFFIPAMCMYLQPPSGNSQDQGKFIALFYTVVTPSLNPLIYTLRNKVVRGAVKRLMGWE

SEQ ID NO: 14217 - protein, 312 aa, Homo sapiens
MENGSYTSYFILLGLFNHTRAHQVLFMMVLSIVLTSLFGNSLMILLIHWDHRLHTPMYFLLSQLSLMDVMLVSTTVPKMAADYLTGSKAISRAGCGAQIFFLPTLGGGECFLLAAMAYDRYAAVCHPLRYPTLMSWQLCLRMNLSCWLLGAADGLLQAVATLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALTRCMGRCVALSRE

SEQ ID NO: 14218 - protein, 309 aa, Homo sapiens
MENSTEVTEFILLGLTDDPNLQIPLLLAFLFIYLITLLGNGGMMVIIHSDSHLHTPMYFFLSNLSLVDLGYSSAVAPKTVAALRSGDKAISYDGCAAQFFFFVGFATVECYLLASMAYDRHAAVCRPLHYTTTMTAGVCALLATGSYVSGFLNASIHAAGTFRLSFCGSNEINHFFCDIPPLLALSCSDTRISKLVVFVAGFNVFFTLLVILISYFFICITIQRMHSAEGQKKVFSTCASHLTALSIFYGTIIFMYLQPNSSQSVDTDKIASVFYTVVIPMLNPLIYSLRNKEVKSALWKILNKLYPQY

SEQ ID NO: 14219 - protein, 313 aa, Homo sapiens
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSFAISVTTECFLLATMAYDRYVAICKPLLYPAIMTNGLCIRLLILSYVGGILHALIHEGFLFRLTFCNSNIVHHIYCDTIPLSKISCTDSSINFLMVFIFSGSIQVFSIVTILVSYTFVLFAILKKKSDKGVRKAFSTCGAHLFSVSLYYGPLLFIYVGPASPQADDQDMVEPLFYTVIIPLLNPIIYSLRNKQVTVSFTKMLKKHVKVSY

SEQ ID NO: 14220 - protein, 313 aa, Homo sapiens
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSIAIGVTTECFLLATMAYDRYVAICKPLLYPAIMTNGLCIRLLILSYIAGILHALIHEGFLFRLTFCNSNIVHHIYCDTIPLSKISCTDSSINFLMVFIFSGSIQVFSIVTILISYTFVLFTVLEKKSDKGVRKAFSTCGAHLFSVCLYYGPLLLMYVGPASPQADGQNMVEPLFYTVIIPLLNPIIYSLRNKQVIVSFIKMLKRNVKVSY

SEQ ID NO: 14221 - protein, 310 aa, Homo sapiens
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSIAIGVTTECFLLATMAYDRYVAICKPLLYPAIMTNGLCIRLLILSYIAGILHALIHEGFLFRLTFCNSNIVHHIYCDTIPLSKISCTDSSINFLMVFIFSGSIQVFSIVTILISYTFVLFTVLEKKSDKGVRKAFSTCGAHLFSVCLYYGPLLLMYVGPASPQADGQNMVEPLFYTVIIPLLNPIIYSLRNKQVIVSFIKMLKRNGI

SEQ ID NO: 14222 - protein, 321 aa, Homo sapiens
MNKENHSLIAEFILTGFTYHPKLKTVLFVVFFAIYLITMVGNIGLVALIYIEQRLHTPMYIFLGNLVLMDSCCSSAITPKMLENFFSEDKRITLYECMAQFYFLCLAETTDCFLLAAMAYDCYVAICNPLQYHTMMSKTLCIQMTAGAYLAGNLHPMIEVEFLLRLTFCGSHQINHFFCDVLPLYRLSCINPYINELVLFILAGSIQIFTIVLVSYFYILFTIFTMKSKEGRGKALSTCASHFLSVSIFCDSLLFMYARPGAVNEGDKDIPVAIFYTLVIPLLNPFIYSLRNKEVINIMKKIMKKRKFCHILKQMSSPLAT

SEQ ID NO: 14223 - protein, 321 aa, Homo sapiens
MERKNQTAITEFIILGFSNLNEWQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 14224 - protein, 321 aa, Homo sapiens; identical to SEQ ID NO: 14223

SEQ ID NO: 14225 - protein, 321 aa, Homo sapiens
MERKNQTAITEFIILGFSNLNELQFLLFTIFFLTYFCTLGGNILMILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 14226 - protein, 321 aa, Homo sapiens; identical to SEQ ID NO: 14225

SEQ ID NO: 14227 - protein, 321 aa, Homo sapiens; identical to SEQ ID NO: 14225

SEQ ID NO: 14228 - protein, 312 aa, Homo sapiens
MEILSNSTSKFPTFLLTGIPGLESAHVWISIPFCCFYAIALSGNSVILFVIITQQSLHEPMYYFLFRLSATDLGLTVSSLSTTLGILWFEAREISLYSCIVQMFFLHGFTFMESGVLVATAFDRYVAICDPLRYTTILTNSRIIQMGLLMITRAIVLILPLLLLLKPLYFCRMNALSHSYCYHPDVIQLACSDIRANSICGLIDLILTTGIDTPCIVLSYILIIHSVLRIASPEEWHKVFSTCVSHVGAVAFFYIHMLSLSLVYRYGRSAPRVVHSVMANVYLLLPPVLNPIIDSVKTKQIRKAMLSLLLTK

SEQ ID NO: 14229 - protein, 319 aa, Homo sapiens
MLQNQDTMEILSNSTSKFPTFLLTGIPGLESAHVWISIPFCCFYAIALSGNSVILFVIITQQSLHEPMYYFLFRLSATDLGLTVSSLSTTLGILWFEAREISLYSCIVQMFFLHGFTFMESGVLVATAFDRYVAICDPLRYTTILTNSRIIQMGLLMITRAIVLILPLLLLLKPLYFCRMNALSHSYCYHPDVIQLACSDIRANSICGLIDLILTTGIDTPCIVLSYILIIHSVLRIASPEEWHKVFSTCVSHVGAVAFFYIHMLSLSLVYRYGRSAPRVVHSVMANVYLLLPPVLNPIIDSVKTKQIRKAMLSLLLTK

SEQ ID NO: 14230 - protein, 326 aa, Homo sapiens
MSVQYSLSPQFMLLSNITQFSPIFYLTSFPGLEGIKHWIFIPFFFMYMVAISGNCFILIIIKTNPRLHTPMYYLLSLLALTDLGLCVSTLPTTMGIFWFNSHSIYFGACQIQMFCIHSFSFMESSVLLMMSFDRLVAICHPLRYSVIITGQQVVRAGLIVIFRGPVATIPIVLLLKAFPYCGSVVLSHSFCLHQEVIQLACTDITFNNLYGLMVVVFTVMLDLVLIALSYGLILHTVAGLASQEEQRRAFQTCTAPLCAVLVFFVPMMGLSLVHRFGKHAPPAIHLLMANVYLFVPPMLNPIIYSIKTKEIHRAIIKFLGLKKASK

SEQ ID NO: 14231 - protein, 314 aa, Homo sapiens
MKNKSMEIEFILLGLTDDPQLQIVIFLFLFLNYTLSLMGNLIIIILTLLDPRLKTPMYFFLRNFSFLEVIFTTVCIPRFLITIVTRDKTISYNNCATQLFFILLPGVTEFYLLAAMSYDRYVAICKPLHYPIIMSSKVCYQLVLSSWVTGFLIIFPPLVMGLKLDFCASKTIDHFMCETSPILQISCTDTHVLELMSFTLAVVTLVVTLVLVILSYTCIIKTILKFSSAQQRNKAFSTCTSHMIVVSMTYGSCIFMYIKPSAKERVTVSKGVALLYTSIAPLLNPFIYTLRNQQVKEVFWDVLQKNLCFSKRPF

SEQ ID NO: 14232 - protein, 312 aa, Homo sapiens
MKNRTSVTDFILLGLTDNPQLQVVIFSFLFLTYVLSVTGNLTIISLTLLDSHLKTPMYFFLRNFSLEISFTSVCNPRFLISILTGDKSISYNACAAQLFFFIFLGSTEFFLLASMSYDCYVAICKPLHYTTIMSDRICYQLIISSWLAGFLVIFPPLAMGLQLDFCDSNVIDHFTCDSAPLLQISCTDTSTLELMSFILALFTLISTLILVILSYTYIIRTILRIPSAQQRKKAFSTCSSHVIVVSISYGSCIFMYVKTSAKEGVALTKGVAILNTSVAPMLNPFIYTLRNQQVKQAFKDVLRKISHKKKKH

SEQ ID NO: 14233 - protein, 37 aa, Homo sapiens
MITDVQLAIFANMLGVSLFLLVVLYHYVAVNNPKKQE

SEQ ID NO: 14234 - protein, 109 aa, Homo sapiens
MSITDVLSADDIAAALQECQDPDTFEPQKFFQTSGLSKMSASQVKDVFRFIDNDQSGYLDEEELKFFLQKFESGARELTESETKSLMAAADNDGDGKIGAEEFQEMVHS

SEQ ID NO: 14235 - protein, 123 aa, Homo sapiens
MKTILGFKGLFYLHSLIWTCAGDWSAIQVHCTQFWFFARIKPTIFYNLYVNPDEVFLGDGCHVTHVLPNVYYEFFYHPHDCGIVTQPLQEVLLLKTKIRYISRDSTVRSEMPLSCVVHKQKCQ

SEQ ID NO: 14236 - protein, 451 aa, Homo sapiens
MGNLLGGVSFREPTTVEDCDSTWQTDSEPEPEEPGPGGGSEGPGQESEQPAQPPEQAGGRPGASPAPDEDAEAAGAEQGGDSTEATAKPKRSFYAARDLYKYRHQYPNFKDIRYQNDLSNLRFYKNKIPFKPDGVYIEEVLSKWKGDYEKLEHNHTYIQWLFPLREQGLNFYAKELTTYEIEEFKKTKEAIRRFLLAYKMMLEFFGIKLTDKTGNVARAVNWQERFQHLNESQHNYLRITRILKSLGELGYESFKSPLVKFILHEALVENTIPNIKQSALEYFVYTIRDRRERRKLLRFAQKHYTPSENFIWGPPRKEQSEGSKAQKMSSPLASSHNSQTSMHKKAKDSKNSSSAVHLNSKTAEDKKVAPKEPVEETDRPSPEPSNEAAKPRNTEKDSNAENMNSQPEKTVTTPTEKKESVSPENNEEGGNDNQDNENPGNTNCHDVVLVQ

SEQ ID NO: 14237 - protein, 189 aa, Homo sapiens
MINTQDSSILPLSNCPQLQCCRHIVPGPLWCSDAPHPLSKIPGGRGGGRDPSLSALIYKDEKLTVTQDLPVNDGKPHIVHFQYEVTEVKVSSWDAVLSSQSLFVEIPDGLLADGSKEGLLALLEFAEEKMKVNYVFICFRKGREDRAPLLKTFSFLGFEIVRPGHPCVPSRPDVMFMVYPLDQNLSDED

SEQ ID NO: 14238 - protein, 2344 aa, Homo sapiens
MIPWSIFLLHVLLFSLQEYICASSILMGTSKNGFNENRQKRALLAAQFEATSPRYFFHDAINWGESKIKGSCPYECLNGAFCSKTGTCDCQIFQALGTRCQIIPNMGNGRDGICKTWGQYHFETFDGIYYYFPGNCSYIFAKDCGDLEPRYTVWVHNSPKCLGSVYSCYRSISLFFSNQEEIRIYGHEIKKNGISLTLPQTIGQIFIEKLADYILVKTTFGFSLAWDGISGIYLKLSEDHKGKSCGLCGNYNDIQSDDFIILQEDYTEDIAMFANSWSVQTPDDTKCVLTPSDFPNPCSSGMPAFEAIFFKCQILLQFPFLSCHEYIDPYLYIASCVNDLCKTDDDETYCRAATEYARACSHAGYPIQDWRDDFPACTDKCDDSFVHRDCISCCPPTCTFEKQCLGSNLHCLDGCYCPDGLVMDNGTCISLENCPCGFHGLAYSVGSKIEQECTECVCVGGVWNCTEQDCPVQCSVVGDSHFTTFDGRHYSFIGMCQYILVKGTGKDKFTITLQKAPCEQNLGLVCLQSITLILEDDFNKQVTLGRGGQILTSPNQGFNLNGIVEIQTLSSLFILLKTTFGLKILFAIDGERIYIQLTSAWKRRTLGLCGTFNGNIRDDFLSPSGMIEGTPQLHANAWRVSSTCFAPVHVPVVDPCNINQQNIGYAAHCDVIHQELFAPCHIYISPGLYYQLCRHDACKCGSSCLCNALAHYAYLCGQHGVPIDFRTQISFCAVVCQKGMLYHHCSSFCLHSCISLSSPEQCSDDCAEGCNCPEGKFYEDTLNFCVPIFHCRCHYRGSVYQPGELIPTPSGLCQCSNGTVKCDELATPSAVHICPEGKEYFDCRFPDPELPAGGVNCETTCANLAMNFTCTPSSPCISGCVCAPGMAEHRGKCYVPESCPCIWKDWEYLSGEVIATPCYTCVCRRGMFNCTYYPCPAVCTIYGDRHYYSFDGLEYDYISDCQVFLIKSADDSDISVIAQNKKCFDNDIVCSKSVLISVGDTEIYLNDTPYKQKQSGFFLENKSTYQLWKAGYYIVVYFPEKDITILWDRKTTIHIKVGPQWKNKLSGLCGNFDKCTSNDMTTSNNLEVRNARVFGDSWALGQCESPDETIKPCEAHQNKFPYAKKECSILYSDIFASCRNVIDVTSFAKNCHEDTCNCNLGGDCECLCTSIAAYAYKCCQEGISIHWRSSTVCSLDCEYYNEGLGEGPYMLASYGQSGLVLGANMTSRSVFCLPRSSVHTSLFFYFMITPGLFKEKVSSLALVSLESAERPNYFLYVHDNDTLSLELWEANSAFHRRATFFHHQGLWIPGYSAFELYSKKGFFIIFTDSSVKASKYDDSEEFKHSSSFSIEEIQAAVPYRKMCEWRYEPCATPCFKTCSDPEALACKFLPPVEGCLPYCPKNMILDEVTLKCVYPRDCIPVIPTEPTLMPPAKPTVPMFTVWEMITPSDITVFDMLTPTTGLECEPQKFDPVYDCSQYICLNMEWQLYNWSLNCPKDVEMPDCGFRGRPVQVNSDICCPEWECPCRCSMLSELSIITFDGNNAALYSMASYILVRIPGEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVGEFTAIDHNFQSDCGCIQYLCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 14239 - protein, 477 aa, Homo sapiens
MWMFSWLCAILIILAIAGMNTIAKTTPHTKFTKKSEEREMPKGLKPSSGPPPEEEETLFTEMAEMAEPITKPSALDSVFGTATLSPFENFTLDPADFFLNCCDCCSPVPGQKGEPGETGQPGPKGEAGNLGIPGPPGVVGPQGPRGYKGEKGLKGERGDQGVPGYPGKPGAQGEPGPKGDKGNIGLGGVKGQKGSKGDTCGNCTKGEKGDQGAMGSPGLHGGPGAKGEKGEMGEKGEMGDKGCCGDSGERGGKGQKGEGGMKGEKGSKGDSGMEGKSGRNGLPGAKGDPGIKGEKGELGPPGLLGPTGPKGDIGNKGVRGPTGKKGSRGFKGSKGELARVPRSAFSAGLSKPFPPPNIPIKFEKILYNDQGNYSPVTGKFNCSIPGTYVFSYHITVRGRPARISLVAQNKKQFKSRETLYGQEIDQASLLVILKLSAGDQVWLEVSKDWNGVYVSAEDDSIFTGFLLYPEETSGISP

SEQ ID NO: 14240 - protein, 571 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTGTSAVEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 14241 - protein, 566 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 14242 - protein, 253 aa, Homo sapiens
MGSDAWVGLWRPHRPRGPIAAHYGGPGPKYKLPPNTGYALHDPSRPRAPAFTFGARFPTQQTTCGPGPGHLVPARMTVRGTDGAPAYSIYGRPRRSAPFLTPGPGRYFPERAGNATYPSAPRHTIAPRNWGVQAEQQSPGPAAYTVPSLLGPRVIGKVSAPTCSIYGRRAAGSFFEDLSKTPGPCAYQVVSPGVYKSRAPQFTILARTSLPQDNTRKPGPAAYNVDQHRKPRGWSFGIRHSDYLAPLVTDADN

SEQ ID NO: 14243 - protein, 253 aa, Homo sapiens; identical to SEQ ID NO: 14242

SEQ ID NO: 14244 - protein, 154 aa, Homo sapiens
MLPGYALHPVAAARPRLHLRRALPHAADDVRPRARPPGARSHDRARHRRRPRLLHLRPPTPLSALPHSGTWSGPPGPWPPQRRTASREAHLGTPDLNPESPSDTLTYSVPPYPDLKSQTPPRGFDKSWLRLPTSPRTPSRVPTRLPRSSSPPHP

SEQ ID NO: 14245 - protein, 274 aa, Homo sapiens
MKLPKGTRSSVYFAQHPEKEPLPSRQEVKQTPVIMAKIKGPGPAKYLRPSCTGYIDHDISMFKAPAYTLHSRHSEKRMVCHSSPGPCYLLDPKITRFGMSSCPQVPMEERISNLRLNPTLASCQYYFEKIHPPGERRAPQYTFGYRRPYRVMDLNPAPNQYQMPLLLGPNTPVSRAAPCYSLASRDKNWFYKEDVAGGPGPTTYARPEPSIYQNRSPTYSMAKRFAYPLDLTPRPGPGSHEVQQVTVHKPHIPAFTMGIKHSLHLCPLVIDIRD

SEQ ID NO: 14246 - protein, 289 aa, Homo sapiens
MGTLSCDSTPRLATAPLGRRVTEGQIPETGLRKSCGTATLENGSGPGLYVLPSTVGFINHDCTRVASPAYSLVRRPSEAPPQDTSPGPIYFLDPKVTRFGRSCTPAYSMQGRAKSRGPEVTPGPGAYSPEKVPPVRHRTPPAFTLGCRLPLKPLDTSAPAPNAYTMPPLWGSQIFTKPSSPSYTVVGRTPPARPPQDPAEIPGPGQYDSPDANTYRQRLPAFTMLGRPRAPRPLEETPGPGAHCPEQVTVNKARAPAFSMGIRHSKRASTMAATTPSRPAGHRLPGRCC

SEQ ID NO: 14247 - protein, 253 aa, Homo sapiens
MGTLSCDSTPRLATAPLGRRVTEGQIPETGLRKSCGTATLENAPPQDTSPGPIYFLDPKVTRFGRSCTPAYSMQGRAKSRGPEVTPGPGAYSPEKVPPVRHRTPPAFTLGCRLPLKPLDTSAPAPNAYTMPPLWGSQIFTKPSSPSYTVVGRTPPARPPQDPAEIPGPGQYDSPDANTYRQRLPAFTMLGRPRAPRPLEETPGPGAHCPEQVTVNKARAPAFSMGIRHSKRASTMAATTPSRPAGHRLPGRCC

SEQ ID NO: 14248 - protein, 1134 aa, Homo sapiens
MGLLASAGLLLLLVIGHPRSLGLKCGIRMVNMKSKEPAVGSRFFSRISSWRNSTVTGHPWQVSLKSDEHHFCGGSLIQEDRVVTAAHCLDSLSEKQLKNITVTSGEYSLFQKDKQEQNIPVSKIITHPEYNSREYMSPDIALLYLKHKVKFGNAVQPICLPDSDDKVEPGILCLSSGWGKISKTSEYSNVLQEMELPIMDDRACNTVLKSMNLPPLGRTMLCAGFPDWGMDACQGDSGGPLVCRRGGGIWILAGITSWVAGCAGGSVPVRNNHVKASLGIFSKVSELMDFITQNLFTGLDRGQPLSKVGSRYITKALSSVQEVNGSQRGKGILDMEKQVGCDHDYVSLRSSSGVLFNQRSLMEDDGKQNKRVCGKILPSPLLAETSEAMVPFVSDTEDSGSGFELTVTAVQKSEAGSGCGSLAILVEEGTNHSAKYPDLYPSNTRCHWFICAPEKHIIKLTFEDFAVKFSPNCIYDAVVIYGDSEEKHKLAKLCGMLTITSIFSSSNMTVIYFKSDGKNRLQGFKARFTILPSESLNKFEPKLPPQNNPVSTVKAILHDVCGIPPFSPQWLSRRIAGGEEACPHCWPWQVGLRFLGDYQCGGAIINPVWILTAAHCVQLKNNPLSWTIIAGDHDRNLKESTEQVRRAKHIIVHEDFNTLSYDSDIALIQLSSPLEYNSVVRPVCLPHSAEPLFSSEICAVTGWGSISADGGLASRLQQIQVHVLEREVCEHTYYSAHPGGITEKMICAGFAASGEKDFCQGDSGGPLVCRHENGPFVLYGIVSWGAGCVQPWKPGVFARVMIFLDWIQSKINGPASLQTNNKCKTLKQQLPPPTPSPDSASWPGCCSEAELEKPRGFFPTPRYLLDYRGRLECSWVLRVSASSMAKFTIEYLSLLGSPVCQDSVLIIYEERHSKRKTAGGLHGRRLYSMTFMSPGPLVRVTFHALVRGAFGISYIVLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIASFAGTLAMILTKDILKREKLNFINTYIMHIWENSVYDNVRSVGKRKQKKFASNLSYSMEAEKSRIQVPADLVPAKGSLSGS

SEQ ID NO: 14249 - protein, 564 aa, Homo sapiens
MLISRNKLILLLGIVFFERGKSATLSLPKAPSCGQSLVKVQPWNYFNIFSRILGGSQVEKGSYPWQVSLKQRQKHICGGSIVSPQWVITAAHCIANRNIVSTLNVTAGEYDLSQTDPGEQTLTIETVIIHPHFSTKKPMDYDIALLKMAGAFQFGHFVGPICLPELREQFEAGFICTTAGWGRLTEGGVLSQVLQEVNLPILTWEECVAALLTLKRPISGKTFLCTGFPDGGRDACQGDSGGSLMCRNKKGAWTLAGVTSWGLGCGRGWRNNVRKSDQGSPGIFTDISKVLPWIHEHIQTGNRRKSSRAWCSEQDVIVSGAEGKLHFPESLHLYYESKQRCVWTLLVPEEMHVLLSFSHLDVESCHHSYLSMYSLEDRPIGKFCGESLPSSILIGSNSLRLKFVSDATDNAAGFNLTYKALKPNYIPDSGCSYLTVLFEEGLIQSLNYPENYSDKANCDWIFQASKHHLIKLSFQSLEIEESGDCTSDYVTVHSDVERKKEIARLCGYDVPTPVLSPSSIMLISFQSDENGTCRGFQATVSFIPKAGKKIELPTLWFPVLILVM

SEQ ID NO: 14250 - protein, 251 aa, Homo sapiens
MPRAFLVRSRRPQPPNWGHLPDQLRGDAYIPDCSSLGGPPAQQSSSVRDPWTAVSVLGTCPPLLLCVGNASPFLVAPGPAATGISSSGAQDSSPHVDDPLYLCMHWRKESASRNQPTQGNLTSAPRGPGTLGCPLCPKAFPLQRMLTRHLKCHSPVRRHLCRCCGKGFHDAFDLKRHMRTHTGIRPFRCSACGKAFTQRCSLEAHLAKVHGQPASYAYRERREKLHVCEDCGFTSSRPDTYAQHRALHRAA

SEQ ID NO: 14251 - protein, 560 aa, Homo sapiens
MGKWRPRGCCRGNMQCRQEVPATLTSSELFSTRNQPQPQPQPLLADAPVPWAVASRMCLTPGQGCGHQGQDEGPLPAPSPPPAMSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGADFAVDPDQPLSAKRNPIDVDPFTYQSTRQEGLYAMGPLAGDNFVRFVQGGALAVASSLLRKETRKPP

SEQ ID NO: 14252 - protein, 477 aa, Homo sapiens
MSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGADFAVDPDQPLSAKRNPIDVDPFTYQSTRQEGLYAMGPLAGDNFVRFVQGGALAVASSLLRKETRKPP

SEQ ID NO: 14253 - protein, 477 aa, Homo sapiens; identical to SEQ ID NO: 14252

SEQ ID NO: 14254 - protein, 505 aa, Homo sapiens
MPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRRSLKGDRVMPEEIARYYKHYVKVMGLQKNFRENTYITSVSRLYRDQDDDDIQDRDISTKHLQIEKSNFIKRNWEIRGYQRIADGSHVPFCLFAENVALATGTLDSPAHLEIEGEDFPFVFHSMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 14255 - protein, 549 aa, Homo sapiens
MPVWCCRCSLAGHFRNYSDTETEGEIFNSLVQYFGDNLGRKVKAMPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRRSLKGDRVMPEEIARYYKHYVKVMGLQKNFRENTYITSVSRLYRDQDDDDIQDRDISTKHLQIEKSNFIKRNWEIRGYQRIADGSHVPFCLFAENVALATGTLDSPAHLEIEGEDFPFVFHSMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 14256 - protein, 527 aa, Homo sapiens
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 14257 - protein, 102 aa, Homo sapiens
MSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 14258 - protein, 111 aa, Homo sapiens
MSEHVRTRSQSSERGNDQESSQPVGSVIVQEPTEEKRQEEEPPTDNQGIAPSGEIENEGAPAVQGPDMEAFQQELALLKIEDEPGDGPDVREGIMPTFDLTKVLEAGDAQP

SEQ ID NO: 14259 - protein, 94 aa, Homo sapiens
MSEHVRTRSQSSERGNDQESSQPVGSVIVQEPTEEKRQEEEPPTDNQGPDMEAFQQELALLKIEDEPGDGPDVREGIMPTFDLTKVLEAGDAQP

SEQ ID NO: 14260 - protein, 130 aa, Homo sapiens
MQAPWAGNRGWAGTREEVRDMSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 14261 - protein, 93 aa, Homo sapiens
MSEHVTRSQSSERGNDQESSQPVGPVIVQQPTEEKRQEEEPPTDNQGTDVEAFQQELALLKIEDAPGDGPDVREGTLPTFDPTKVLEAGEGQL

SEQ ID NO: 14262 - protein, 110 aa, Homo sapiens
MSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 14263 - protein, 1090 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 14264 - protein, 1103 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 14265 - protein, 433 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGVGWENVLLKEGESASNATETSGPDMTIKKPPQLSE

SEQ ID NO: 14266 - protein, 467 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 14267 - protein, 468 aa, Homo sapiens
MLPPWTLGLLLLATVRGRKVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTSKYKISVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 14268 - protein, 140 aa, Homo sapiens
MAAIPSSGSLVATHDYYRRRLGSTSSNSSCSSTECPGEAIPHPPGECRIAPFSPRSSRSWQHQDPTSLLSGLPKADPGHWWASFFFGKSTLPFMATVLESAEHSEPPQASSSMTACGLARDAPRKQPGGQSSTASAGPPS

SEQ ID NO: 14269 - protein, 70 aa, Homo sapiens
MAAIPSSGSLVATHDYYRRRLGSTSSNSSCSSTECPGEAIPHPPGLPKADPGHWWASFFFGKSTLPPPTL

SEQ ID NO: 14270 - protein, 114 aa, Homo sapiens
MAAIPSSGSLVATHDYYRRRLGSTSSNSSCSSTECPGEAIPHPPGLPKADPGHWWASFFFGKSTLPFMATVLESAEHSEPPQASSSMTACGLARDAPRKQPGGQSSTASAGPPS

SEQ ID NO: 14271 - protein, 619 aa, Homo sapiens
MYRSGERLLGSHALPAEQRDFLPLETTNNNNNHHQPGAWARRAGSSASSPPSASSSPHPSAAVPAADPADSASGSSNKRKRDNKPSGGRAAGGGRADGGGVVYSGTPWKRRNYNQGVVGLHEEISDFYEYMSPRPEEEKMRMEVVNRIESVIKELWPSADVQIFGSFKTGLYLPTSDIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGNGVTLIVDTQQLDKCNNNLSEENEALGKCRSKTSESLSKHSSNSSSGPVSSSSATQSSSSDVDSDATPCKTPKQLLCRPSTGNRVGSQDVSLESSQAVGKMQSTQTTNTSNSTNKSQHGSARLFRSSSKGFQGTTQTSHGSLMTNKQHQGKSNNQYYHGKKRKHKRDAPLSDLCR

SEQ ID NO: 14272 - protein, 698 aa, Homo sapiens
MRPRPRSAPGKPRRRSRARLRSSRTPSGGASGGGGSSSSSSTATGGSGSSTGSPGGAASAPAPAPAGMYRSGERLLGSHALPAEQRDFLPLETTNNNNNHHQPGAWARRAGSSASSPPSASSSPHPSAAVPAADPADSASGSSNKRKRDNKASTYGLNYSLLQPSGGRAAGGGRADGGGVVYSGTPWKRRNYNQGVVGLHEEISDFYEYMSPRPEEEKMRMEVVNRIESVIKELWPSADVQIFGSFKTGLYLPTSDIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGNGVTLIVDTQQLDKCNNNLSEENEALGKCRSKTSESLSKHSSNSSSGPVSSSSATQSSSSDVDSDATPCKTPKQLLCRPSTGNRVGSQDVSLESSQAVGKMQSTQTTNTSNSTNKSQHGSARLFRSSSKGFQGTTQTSHGSLMTNKQHQGKSNNQYYHGKKRKHKRDAPLSDLCR

SEQ ID NO: 14273 - protein, 173 aa, Homo sapiens
MDIEKVNSMDLGEFVDVFGNATERCPLIAAAVWSQRPFSDLEDLEKHFFAFIDALAQSGQEGILRCHPDLAGSELQRGTLTAESQREQSGAGLRSLGADERLRLAELNAQYRARFGFPFVLAARFSDRTAVPRELARRLLCPSAQELRTALGEVKKIGSLRLADLLRADPAKL

SEQ ID NO: 14274 - protein, 673 aa, Homo sapiens
MAESSLYRQRLEVIAEKRRLQEEIRAARREVEEEKLRVERLKRKSLRERWLMDGAAAVPEPSEDPTSKDPQSPEGQAQARIRNLEDSLFTLQSQLQLLQSASTGAQHKPSGRPSWRRQGHRPLSQSIVEAGSVGQTDLNKRASLPAGLVGTPPESPSEPREDVLGFLPGPRQVPGAAGDSSEANGPCPSPIPTPEQGLSQRAVPSEGRVGEAKGGGVVSVVWEGLRATEDCATGATGPELEAKVEEVVLEAIGDRKGAGSLELPAWVKEDRGIVEVVWEGVGGSDAEAMGEIGRVPEVVQTSSPRLQERLEAAASIEGEDVPQGSPEGDGQGGSGGEEGSFIWVERVTLSEEWEELLVEGLEGPEVAGRERGDESPLGAEGAKTGGGEETWEAEKRKAEESMGIGSEEKPGTGRDEAEMSPVVERKGGEKKLELESRGSAEKLGTEREGGEEPLGIERKVEGHLRAEKEGDEEKRGAEEEEVEEPLGVEKKGGEEEPEATKEPLEAERKGGEETLEAEKRGGEESLETEKTQGTEGDLNLEQGSREGSESQAEEMNEAGPPLEANTETRPEKEGPQPQEKPVGALEEEGVKPQTAAEGQGPLGDATPLLAETPAPEQPAECQPLLQGEGPSANPSAHPVPTYAPARQPEPSAPTEGEEASGPKQKTCQCCAVM

SEQ ID NO: 14275 - protein, 448 aa, Homo sapiens
MALTLLEDWCKGMDMDPRKALLIVGIPMECSEVEIQDTVKAGLQPLCAYRVLGRMFRREDNAKAVFIELADTVNYTTLPSHIPGKGGSWEVVVKPRNPDDEFLSRLNYFLKDEGRSMTDVARALGCCSLPAESLDAEVMPQVRSPPLEPPKESMWYRKLKVFSGTASPSPGEETFEDWLEQVTEIMPIWQVSEVEKRRRLLESLRGPALSIMRVLQANNDSITVEQCLDALKQIFGDKEDFRASQFRFLQTSPKIGEKVSTFLLRLEPLLQKAVHKSPLSVRSTDMIRLKHLLARVAMTPALRGKLELLDQRGCPPNFLELMKLIRDEEEWENTEAVMKNKEKPSGRGRGASGRQARAEASVSAPQATVQARSFSDSSPQTIQGGLPPLVKRRRLLGSESTRGEDHGQATYPKAENQTPGREGPQAAGEELGNEAGAGAMSHPKPWET

SEQ ID NO: 14276 - protein, 140 aa, Homo sapiens
MALTLLEDWCKGMDMDPRKALLIVGIPMECSEVEIQDTVKAGLQPLCAYRVLGRMFRREDNAKAVFIELADTVNYTTLPSHIPGKGGSWEVVVKPRNPDDEFLSRLNYFLKDEGRSMTDVARALGCCSLPAESLDAEVMP

SEQ ID NO: 14277 - protein, 448 aa, Homo sapiens; identical to SEQ ID NO: 14275

SEQ ID NO: 14278 - protein, 448 aa, Homo sapiens; identical to SEQ ID NO: 14275

SEQ ID NO: 14279 - protein, 448 aa, Homo sapiens; identical to SEQ ID NO: 14275

SEQ ID NO: 14280 - protein, 399 aa, Homo sapiens
MAVTMLQDWCRWMGVNARRGLLILGIPEDCDDAEFQESLEAALRPMGHFTVLGKVFREEDNATAALVELDREVNYALVPREIPGTGGPWNVVFVPRCSGEEFLGLGRVFHFPEQEGQMVESVAGALGVGLRRVCWLRSIGQAVQPWVEAVRYQSLGVFSGRDQPAPGEESFEVWLDHTTEMLHVWQGVSERERRRRLLEGLRGTALQLVHALLAENPARTAQDCLAALAQVFGDNESQATIRVKCLTAQQQSGERLSAFVLRLEVLLQKAMEKEALARASADRVRLRQMLTRAHLTEPLDEALRKLRMAGRSPSFLEMLGLVRESEAWEASLARSVRAQTQEGAGARAGAQAVARASTKVEAVPGGPGREPEGLRQAGGQEAEELLQEGLKPVLEECDN

SEQ ID NO: 14281 - protein, 399 aa, Homo sapiens; identical to SEQ ID NO: 14280

SEQ ID NO: 14282 - protein, 399 aa, Homo sapiens; identical to SEQ ID NO: 14280

SEQ ID NO: 14283 - protein, 399 aa, Homo sapiens
MAVTMLQDWCRWMGVNARRGLLILGIPEDCDDAEFQESLEAALRPMGHFTVLGKAFREEDNATAALVELDREVNYALVPREIPGTGGPWNVVFVPRCSGEEFLGLGRVFHFPEQEGQMVESVAGALGVGLRRVCWLRSIGQAVQPWVEAVRCQSLGVFSGRDQPAPGEESFEVWLDHTTEMLHVWQGVSERERRRRLLEGLRGTALQLVHALLAENPARTAQDCLAALAQVFGDNESQATIRVKCLTAQQQSGERLSAFVLRLEVLLQKAMEKEALARASADRVRLRQMLTRAHLTEPLDEALRKLRMAGRSPSFLEMLGLVRESEAWEASLARSVRAQTQEGAGARAGAQAVARASTKVEAVPGGPGREPEGLLQAGGQEAEELLQEGLKPVLEECDN

SEQ ID NO: 14284 - protein, 399 aa, Homo sapiens; identical to SEQ ID NO: 14283

SEQ ID NO: 14285 - protein, 448 aa, Homo sapiens; identical to SEQ ID NO: 14275

SEQ ID NO: 14286 - protein, 448 aa, Homo sapiens; identical to SEQ ID NO: 14275

SEQ ID NO: 14287 - protein, 448 aa, Homo sapiens; identical to SEQ ID NO: 14275

SEQ ID NO: 14288 - protein, 448 aa, Homo sapiens; identical to SEQ ID NO: 14275

SEQ ID NO: 14289 - protein, 635 aa, Homo sapiens
MAMSLLQDWCRSLDVDAHRALLVTGIPEGLEQADVEAVLQPTLLPLGTFRLRHMKALMNEKAQAALVEFVEDVNHAAIPREIPGKDGVWRVLWKDRAQDTRVLRQMRRLLLDDGPTQAAEAGTPGEAPTPPASETQAQDSGEVTGQAGSLLGAARNPRRGRRGRRNRTRRNRLTQKGKKRSRGGRPSAPARSEAEDSSDESLGIVIEEIDQGDLSGEEDQSALYATLQAAARELVRQWAPCNSEGEEDGPREFLALVTVTDKSKKEEAEKEPAGAESIRLNTKEDKNGVPDLVALLAVRDTPDEEPVDSDTSESDSQESGDQETEELDNPEFVAIVAYTDPSDPWAREEMLKIASVIESLGWSDEKDKRDPLRQVLSVMSKDTNGTRVKVEEAGREVDAVVLRKAGDDGDLRECISTLAQPDLPPQAKKAGRGLFGGWSEHREDEGGLLELVALLAAQDMAEVMKEEKENAWEGGKYKYPKGKLGEVLALLAARENMGSNEGSEEASDEQSEEESEDTESEASEPEDRASRKPRAKRARTAPRGLTPAGAPPTASGARKTRAGGRGRGRGVTPEKKAGSRGSAQDDAAGSRKKKGSAGAGAHARAGEAKGQAPTGSKAARGKKARRGRRLPPKCR

SEQ ID NO: 14290 - protein, 221 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSGSLSIIKSKIPTYCSICC

SEQ ID NO: 14291 - protein, 221 aa, Homo sapiens; identical to SEQ ID NO: 14290

SEQ ID NO: 14292 - protein, 248 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSLSKRLMDKKFKEPITSALQKLEQHGGSGSLSIIKSKIPTYCSICC

SEQ ID NO: 14293 - protein, 91 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPC

SEQ ID NO: 14294 - protein, 85 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYS

SEQ ID NO: 14295 - protein, 221 aa, Homo sapiens; identical to SEQ ID NO: 14290

SEQ ID NO: 14296 - protein, 136 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSK

SEQ ID NO: 14297 - protein, 203 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTS

SEQ ID NO: 14298 - protein, 122 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAE

SEQ ID NO: 14299 - protein, 102 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRL

SEQ ID NO: 14300 - protein, 123 aa, Homo sapiens
MQKSEGSGGTQLKNRATGNYDQRTSSSTQLKHRNAVQGSKSSLSTSSPESARKLHPRPSDKLNPKTINPVHSDDEVFERGLNALVQLSVVVGPSLNDHLKHLLTSGSLSIIKSKIPTYCSICC

SEQ ID NO: 14301 - protein, 123 aa, Homo sapiens; identical to SEQ ID NO: 14300

SEQ ID NO: 14302 - protein, 253 aa, Homo sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 14303 - protein, 190 aa, Homo sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDI

SEQ ID NO: 14304 - protein, 253 aa, Homo sapiens; identical to SEQ ID NO: 14302

SEQ ID NO: 14305 - protein, 166 aa, Homo sapiens
MARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 14306 - protein, 322 aa, Homo sapiens
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKICDVGVSLPLDENMTVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 14307 - protein, 519 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 14308 - protein, 519 aa, Homo sapiens; identical to SEQ ID NO: 14307

SEQ ID NO: 14309 - protein, 202 aa, Homo sapiens
MAEGEEEGGDVLISVGHANVLGYTLREFLQLLQHITIGTVLQIKVYRDFINIPEEWQEIYDLIPEAKFPVTSTPKKIELAKDESFTSSDDNENVDLDKRLQYYRYPWSTVHHPARRPISISRDWHGYKKKNHTISVGKDINCDVMIHRDDKKEVRAPSPYWIMVKQDNESSSSSTSSTSDAFWLEDCAQVEEGKAQLVSKVG

SEQ ID NO: 14310 - protein, 264 aa, Homo sapiens
MQKASHKNKKERGVSNKVKTSVHNLSKTQQTKLTVGSLGLGLIIIQHGPYLQITHLIRKGAAANDGKLQPGDVLISVGHANVLGYTLREFLQLLQHITIGTVLQIKVYRDFINIPEEWQEIYDLIPEAKFPVTSTPKKIELAKDESFTSSDDNENVDLDKRLQYYRYPWSTVHHPARRPISISRDWHGYKKKNHTISVGKDINCDVMIHRDDKKEVRAPSPYWIMVKQDNESSSSSTSSTSDAFWLEDCAQVEEGKAQLVSKVG

SEQ ID NO: 14311 - protein, 204 aa, Homo sapiens
MQKASHKNKKGDVLISVGHANVLGYTLREFLQLLQHITIGTVLQIKVYRDFINIPEEWQEIYDLIPEAKFPVTSTPKKIELAKDESFTSSDDNENVDLDKRLQYYRYPWSTVHHPARRPISISRDWHGYKKKNHTISVGKDINCDVMIHRDDKKEVRAPSPYWIMVKQDNESSSSSTSSTSDAFWLEDCAQVEEGKAQLVSKVG

SEQ ID NO: 14312 - protein, 700 aa, Homo sapiens
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQMLKEERLQPMESNYTVLIGGCGRVGYLKKAFNLYNQMKKRDLEPSDATYTALFNVCAESPWKDSALQSALKLRQQLQAKNFELNLKTYHALLKMAAKCADLRMCLDVFKEIIHKGHVVTEETFSFLLMGCIQDKKTGFRYALQVWRLMLSLGLQPSRDSYNLLLVAARDCGLGDPQVASELLLKPREEATVLQPPVSRQRPRRTAQAKAGNLMSAMLHVEALERQLFLEPSQALGPPEPPEARVPGKAQPEVDTKAEPSHTAALTAVALKPPPVELEVNLLTPGAVPPTVVSFGTVTTPADRLALIGGLEGFLSKMAEHRQQPDIRTLTLLAEVVESGSPAESLLLALLDEHQVEADLTFFNTLVRKKSKLGDLEGAKALLPVLAKRGLVPNLQTFCNLAIGCHRPKDGLQLLTDMKKSQVTPNTHIYSALINAAIRKLNYTYLISILKDMKQNRVPVNEVVIRQLEFAAQYPPTFDRYQGKNTYLEKIDGFRAYYKQWLTVMPAEETPHPWQKFRTKPQGDQDTGKEADDGCALGGR

SEQ ID NO: 14313 - protein, 106 aa, Homo sapiens
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSA

SEQ ID NO: 14314 - protein, 144 aa, Homo sapiens
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCK

SEQ ID NO: 14315 - protein, 164 aa, Homo sapiens
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQML

SEQ ID NO: 14316 - protein, 70 aa, Homo sapiens
MDFVRLARLFARARPMGLFILQHLDPCRARWAGGREGLMRPMWAPFSSSSSQLPLGQERQENTGSLGSDP

SEQ ID NO: 14317 - protein, 482 aa, Homo sapiens
RKRLVRRGDRAGLPVGVHQLQAKNFELNLKTYHALLKMAAKCADLRMCLDVFKEIIHKGHVVTEETFSFLLMGCIQDKKTGFRYALQVWRLMLSLGLQPSRDSYNLLLVAARDCGLGDPQVASELLLKPREEATVLQPPVSRQRPRRTAQAKAGNLMSAMLHVEALERQLFLEPSQALGPPEPPEARVPGKAQPEVDTKAEPSHTAALTAVALKPPPVELEVNLLTPGAVPPTVVSFGTVTTPADRLALIGGLEGFLSKMAEHRQQPDIRTLTLLAEVVESGSPAESLLLALLDEHQVEADLTFFNTLVRKKSKLGDLEGAKALLPVLAKRGLVPNLQTFCNLAIGCHRPKDGLQLLTDMKKSQVTPNTHIYSALINAAIRKLNYTYLISILKDMKQNRVPVNEVVIRQLEFAAQYPPTFDRYQGKNTYLEKIDGFRAYYKQWLTVMPAEETPHPWQKFRTKPQGDQDTGKEADDGCALGGR

SEQ ID NO: 14318 - protein, 749 aa, Homo sapiens
MASVVPVKDKKLLEVKLGELPSWILMRDFSPSGIFGAFQRGPGGTGKPEMDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQMLKEERLQPMESNYTVLIGGCGRVGYLKKAFNLYNQMKKRDLEPSDATYTALFNVCAESPWKDSALQSALKLRQQLQAKNFELNLKTYHALLKMAAKCADLRMCLDVFKEIIHKGHVVTEETFSFLLMGCIQDKKTGFRYALQVWRLMLSLGLQPSRDSYNLLLVAARDCGLGDPQVASELLLKPREEATVLQPPVSRQRPRRTAQAKAGNLMSAMLHVEALERQLFLEPSQALGPPEPPEARVPGKAQPEVDTKAEPSHTAALTAVALKPPPVELEVNLLTPGAVPPTVVSFGTVTTPADRLALIGGLEGFLSKMAEHRQQPDIRTLTLLAEVVESGSPAESLLLALLDEHQVEADLTFFNTLVRKKSKLGDLEGAKALLPVLAKRGLVPNLQTFCNLAIGCHRPKDGLQLLTDMKKSQVTPNTHIYSALINAAIRKLNYTYLISILKDMKQNRVPVNEVVIRQLEFAAQYPPTFDRYQGKNTYLEKIDGFRAYYKQWLTVMPAEETPHPWQKFRTKPQGDQDTGKEADDGCALGGR

SEQ ID NO: 14319 - protein, 436 aa, Homo sapiens
MRPGGERPVEGGACNGRSELELLKLRSAECIDEAAERLGALSRAIWSQPELAYEEHHAHRVLTHFFEREPPAASWAVQPHYQLPTAFRAEWEPPEARAPSATPRPLHLGFLCEYDALPGIGHACGHNLIAEVGAAAALGVRGALEGLPRPPPPVKVVVLGTPAEEDGGGKIDLIEAGAFTNLDVVFMAHPSQENAAYLPDMAEHDVTVKYYGKASHSASYPWEGLNALDAAVLAYNNLSVFRQQMKPTWRVHGIIKNGGVKPNIIPSYSELIYYFRAPSMKELQVLTKKAEDCFRAAALASGCTVEIKGGAHDYYNVLPNKSLWKAYMENGRKLGIEFISEDTMLNGPSGSTDFGNVSFVVPGIHPYFHIGSNALNHTEQYTEAAGSQEAQFYTLRTAKALAMTALDVIFKPELLEGIREDFKLKLQEEQFVNAVE

SEQ ID NO: 14320 - protein, 279 aa, Homo sapiens
MARPQPCGPPHARCGSPSLPERPLQVKVVGLFSCPNFQIAKSAAEELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANKGRHSNGSQFYITLQATPYLDRKFVAFGQLIEGTEVLKQLELVPTQNERPIHMCRITDSGDPYA

SEQ ID NO: 14321 - protein, 311 aa, Homo sapiens
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANKGRHSNGSQFYITLQATPYLDRKFVAFGQLIEGTEVLKQLELVPTQNERPIHMCRITDSGDPYA

SEQ ID NO: 14322 - protein, 337 aa, Homo sapiens
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEELYGSLKRSVKRQKESRGVGKIEKYRDENFSVPHNKRGVLGMANKGRHSNGSQFYITLQATPYLDRKFVAFGQLIEGTEVLKQLELVPTQNERPIHMCRITDSGDPYA

SEQ ID NO: 14323 - protein, 164 aa, Homo sapiens
MVNSVVFFEITRDGKPLGRISIKLFADKIPKTAENFRALSTGEKGFRYKGSCFHRIIPGFMCQGGDFTRPNGTGDKSIYGEKFDDENLIRKHTGSGILSMANAGPNTNGSQFFICAAKTEWLDGKHVAFGKVKERVNIVEATEHFGYRNSKTSKKITIADCGQF

SEQ ID NO: 14324 - protein, 164 aa, Homo sapiens; identical to SEQ ID NO: 14323

SEQ ID NO: 14325 - protein, 140 aa, Homo sapiens
MHRGVGPAFRVVRKMAASGAEPQVLVQYLVLRKDLSQAPFSWPAGALVAQACHAATAALHTHRDHPHTAAYLQELGRMRKVVLEAPDETTLKELAETLQQKNIDHMLWLEQPENIATCIALRPYPKEEVGQYLKKFRLFK

SEQ ID NO: 14326 - protein, 130 aa, Homo sapiens
MADGKAGDEKPEKSQRAGAAGGPEEEAEKPVKTKTVSSSNGGESSSRSAEKRSAEEEAADLPTKPTKISKFGFAIGSQTTKKASAISIKLGSSKPKETVPTLAPKTLSVAAAFNEDEDGYTNISWTKLLQ

SEQ ID NO: 14327 - protein, 73 aa, Homo sapiens; identical to SEQ ID NO: 10296

SEQ ID NO: 14328 - protein, 888 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKKEKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRYPS

SEQ ID NO: 14329 - protein, 663 aa, Homo sapiens
MIVQMTVILKLEMPQDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 14330 - protein, 404 aa, Homo sapiens
MFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 14331 - protein, 573 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGIRSWDFSALLMKIPSYSPISLSGLPES

SEQ ID NO: 14332 - protein, 443 aa, Homo sapiens
MHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGIRSWDFSALLMKIPSYSPISLSGLPES

SEQ ID NO: 14333 - protein, 285 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQV

SEQ ID NO: 14334 - protein, 1017 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 14335 - protein, 531 aa, Homo sapiens
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKPPPRLLSSPHPATHHCPLHPSSLPLTPPSPSLSPSPLHGIFQVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 14336 - protein, 489 aa, Homo sapiens
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 14337 - protein, 477 aa, Homo sapiens
MRRQPQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 14338 - protein, 290 aa, Homo sapiens [sequence omitted]

SEQ ID NO: 14339 - protein, 580 aa, Homo sapiens
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTSFRFP

SEQ ID NO: 14340 - protein, 140 aa, Homo sapiens
MYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKVSRGECWRVGGRTVCWVSLGSPLGSV

SEQ ID NO: 14341 - protein, 144 aa, Homo sapiens
MYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 14342 - protein, 199 aa, Homo sapiens
MRQSREELIKRGVLKEIYDKDGELSISNEEDSLENGQSLSSSQLSLPALSEMEPVPMPRDPCSYEVLQPSDIMDGPVSEESPSASESGVLLSQDPSAKPVLLLPPKKPAAFPGDHEETPVKQLPLLKQPPALPPKPTTRIANHLTDWHQAHQVGQRHPLPPWQWAFSSPGSSKRIQSRPGAVAYACNPSTLGGRGRWIT

SEQ ID NO: 14343 - protein, 169 aa, Homo sapiens
MDYPKMDYFLDVESAHRLLDVESAQRFFYSQGAQARRATLLLPPTLMAASSEDDIDRRPIRRVRSKSDTPYLAEARISFNLGAGVSLFGDMDEARMGPAVPTLGRPLGLELCSLENHGLLKTAPTYTTSAHICSGPSTGGQFSTQGMSPVQGAKRRRVVWLPLEGEEFG

SEQ ID NO: 14344 - protein, 484 aa, Homo sapiens
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKRK

SEQ ID NO: 14345 - protein, 265 aa, Homo sapiens
  MOD_RES (1)..(1): Any amino acid
XSPFTPFSPLLSFFLSPFFFLFPSLSHSLPTPSLPLPSPFPSPSPVREPLPLPSSPFRLSPSPSVSFSLSARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPSA

SEQ ID NO: 14346 - protein, 415 aa, Homo sapiens
  MOD_RES (1)..(1): Any amino acid
XGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 14347 - protein, 547 aa, Homo sapiens
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPSASESGVLLSQDPSAKPVLLLPPKKPAAFPGDHEETPVKQLPLLKQPPALPPKPTTRIANHLTDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRNKFRRDFGRQLEGK

SEQ ID NO: 14348 - protein, 230 aa, Homo sapiens
NLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPSASESGVLLSQDPSAKPVLLLPPKKPAAFPGDHEETPVKQLPLLKQPPALPPKPTTRIANHLTDWHQAHQVGQRHPLPPWQWAFSSPGSSKRIQSRPGAVAYACNPSTLGGRGRWIT

SEQ ID NO: 14349 - protein, 435 aa, Homo sapiens
MRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTSFRFP

SEQ ID NO: 14350 - protein, 554 aa, Homo sapiens
MDNAVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 14351 - protein, 565 aa, Homo sapiens
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 14352 - protein, 178 aa, Homo sapiens
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQAGSSHSKKTTGSKASASPSTSSTSSRPKASKETVSSKAGTVGTTKGKRKTDKQPITSHLSSDTTTSGTSDLKGEPAETRV

SEQ ID NO: 14353 - protein, 634 aa, Homo sapiens
MDNAVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKENTENHSETPAAPALPPSAPPKPRPKPKPKKSPVPPKGATAGASHKGDEVPPIKKNTKAPGKQAPVPPPKPASRNTTREAAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 14354 - protein, 645 aa, Homo sapiens
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKENTENHSETPAAPALPPSAPPKPRPKPKPKKSPVPPKGATAGASHKGDEVPPIKKNTKAPGKQAPVPPPKPASRNTTREAAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 14355 - protein, 712 aa, Homo sapiens
MGQADVSRPVNPDAVEEADQPTTEPGMVLDSVEAGDTTPPTKRKSKFSGFGKIFKPWKWRKKKSSDKFKETSEVLERKISMRKPREELVKRGVLLEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKREIKRRLTRKLSQRPTVAELLARKILRFNEYVEVTDAQDYDRRADKPWTKLTPADKAAIRKELNEFKSSEMEVHEESKHFTRYHRP

SEQ ID NO: 14356 - protein, 645 aa, Homo sapiens
ERPAEEADQPTTEPGMVLDSVEAGDTTPPTKRKSKFSGFGKIFKPWKWRKKKSSDKFKETSEVLERKISMRKPREELVKRGVLLEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQQYRVKFGLKSLLTEKVWASLGLFVSMFSLTNPSPVLSALLG

SEQ ID NO: 14357 - protein, 702 aa, Homo sapiens
MEDPFEEADQPTTEPGMVLDSVEAGDTTPPTKRKSKFSGFGKIFKPWKWRKKKSSDKFKETSEVLERKISMRKPREELVKRGVLLEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKREIKRRLTRKLSQRPTVAELLARKILRFNEYVEVTDAQDYDRRADKPWTKLTPADKAAIRKELNEFKSSEMEVHEESKHFTRYHRP

SEQ ID NO: 14358 - protein, 267 aa, Homo sapiens
MSGCFPVSGLRCLSRDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 14359 - protein, 292 aa, Homo sapiens
MCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 14360 - protein, 204 aa, Homo sapiens
MSGCFPVSGLRCLSRDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDG

SEQ ID NO: 14361 - protein, 111 aa, Homo sapiens
MCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQGVRP

SEQ ID NO: 14362 - protein, 292 aa, Homo sapiens; identical to SEQ ID NO: 14359

SEQ ID NO: 14363 - protein, 241 aa, Homo sapiens
MKILLVFDFDNTIIDDNSDTWIVQCAPNKKLPIELRDSYRKGFWTEFMGRVFKYLGDKGVREHEMKRAVTSLPFTPGMVELFNFIRKNKDKFDCIIISDSNSVFIDWVLEAASFHDIFDKVFTNPAAFNSNGHLTVENYHTHSCNRCPKNLCKKVVLIEFVDKQLQQGVNYTQIVYIGDGGNDVCPVTFLKNDDVAMPRKGYTLQKTLSRMSQNLEPMEYSVVVWSSGVDIISHLQFLIKD

SEQ ID NO: 14364 - protein, 136 aa, Homo sapiens
MKILLVFDFDNTIIDDNSDTWIVQCAPNKKLPIELRDSYRKGFWTEFMGRVFKYLGDKGVREHEMKRAVTSLPFTPGMVELFNFIRKNKDKFDCIIISDSNSVFIDWVLEAASFHDIFDKVFTNPAAFNSNGHLTV

SEQ ID NO: 14365 - protein, 56 aa, Homo sapiens
MKILLVFDFDNTIIDDNSDTWIVQCAPNKKLPIELRDSYRKGFWTEFMGRVFKYLG

SEQ ID NO: 14366 - protein, 49 aa, Homo sapiens
MKILLVFDFDNTIIDDNSDTWIVQCAPNKKLPIELRDSYRKGFWTEFMG

SEQ ID NO: 14367 - protein, 311 aa, Homo sapiens
MVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 14368 - protein, 407 aa, Homo sapiens
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKPPHPIPAGDILSSEGCSQCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 14369 - protein, 389 aa, Homo sapiens
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 14370 - protein, 504 aa, Homo sapiens
MSEKQMKEAFVSNLNGTTVLEITQGLCFPAFCILCRGFLIIFSQYLCSFSPTWKTRFLTDFVVLIVPMVATLTIWASFILLELLGVIIFGAGLLYQIYRRRTCYARLPFLKILEKFLNISLESEYNPAISCFRVITSAFTAIAILAVDFPLFPRRFAKTELYGTGAMDFGVGGFVFGSAMVCLEVRRRKYMEGSKLHYFTNSLYSVWPLVFLGIGRLAIIKSIGYQEHLTEYGVHWNFFFTIIVVKLITPLLLIIFPLNKSWIIALGITVLYQLALDFTSLKRLILYGTDGSGTRVGLLNANREGIISTLGYVAIHMAGVQTGLYMHKNRSHIKDLIKVACFLLLAAISLFISLYVVQVNVEAVSRRMANLAFCIWIVASSLILLSSLLLGDIILSFAKFLIKGALVPCSWKLIQSPVTNKKHSESLVPEAERMEPSLCLITALNRKQLIFFLLSNITTGLINLMVDTLHSSTLWALFVVNLYMFSNCLIVYVLYLQDKTVQFW

SEQ ID NO: 14371 - protein, 268 aa, Homo sapiens
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSSPVDDIESHAQTST

SEQ ID NO: 14372 - protein, 268 aa, Homo sapiens
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYKCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSSPVDDIESHAQTST

SEQ ID NO: 14373 - protein, 332 aa, Homo sapiens
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYKCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDEVREFERATQEATNKKIGIFPPAISISSIPLLPSSVRSAPSSAPSTPLSTDAPEFLSVPKDRPRKKSAPETLTLPDPEKKATLNLPGMHSSDKPCRPKSE

SEQ ID NO: 14374 - protein, 266 aa, Homo sapiens
MHNILKKYHQYIVECHGITLLPQFLGMYRLNVDGVEIYVIVTRNVFSHRLSVYRKYDLKMANLKATFTFPKPTGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 14375 - protein, 222 aa, Homo sapiens
MWGVNHSINELSHVQIPVMLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKSPTPAIVVLPVPHSAATSEKHCIDPMRVLLHFSSSNC

SEQ ID NO: 14376 - protein, 406 aa, Homo sapiens
MATPGNLGSSVLASKTKTKKKHFVAQKVKLFRASDPLLSVLMWGVNHSINELSHVQIPVMLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 14377 - protein, 215 aa, Homo sapiens
INELSHVQIPVMLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKSPTPAIVVLPVPHSAATSEKHCIDPMRVLLHFSSSNC

SEQ ID NO: 14378 - protein, 75 aa, Homo sapiens
INELSHVQIPVMLMPDDFKAYSKIKVDNHLFNKENMPSHFKFKEYCPMVFRNLRERFGIDDQDFQVSCVCNICFQ

SEQ ID NO: 14379 - protein, 347 aa, Homo sapiens
MLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 14380 - protein, 323 aa, Homo sapiens
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNIFGDMLCPRGEVPTLRQLWSRGQQVIVSYEDESSLRRHHELWPGVPYWWGNRVKTEALIRYLETMKSCGRPGGLFVAGINLTENLQYVLAHPSESLEKMTLPNLPRLSAWVREQCPGPGSRCTNIIAGDFIGADGFVSDVIALNQKLLWC

SEQ ID NO: 14381 - protein, 323 aa, Homo sapiens; identical to SEQ ID NO: 14380

SEQ ID NO: 14382 - protein, 323 aa, Homo sapiens; identical to SEQ ID NO: 14380

SEQ ID NO: 14383 - protein, 178 aa, Homo sapiens
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNIFGDM

SEQ ID NO: 14384 - protein, 60 aa, Homo sapiens
MGGQVSASNSFSRLHCRNANEDWMSALCPRLWDVPLHHLSIPGSHDTMTYCLNKKSPISH

SEQ ID NO: 14385 - protein, 174 aa, Homo sapiens
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNI

SEQ ID NO: 14386 - protein, 74 aa, Homo sapiens
MGGQVSASNSFSRLHCRNANEDWMSALCPRLWDVPLHHLSIPGSHDTMTYCLNKKSPISHEESRLLQLLNKALP

SEQ ID NO: 14387 - protein, 88 aa, Homo sapiens
MGGQVSASNSFSRLHCRNANEDWMSALCPRLWDVPLHHLSIPGSHDTMTYCLNKKSPISHEESRLLQLLNKALPCITRPVVLKWSVTQ

SEQ ID NO: 14388 - protein, 174 aa, Homo sapiens; identical to SEQ ID NO: 14385

SEQ ID NO: 14389 - protein, 124 aa, Homo sapiens
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMV

SEQ ID NO: 14390 - protein, 304 aa, Homo sapiens
MLAVRKARRKLRMGTICSPNPSGTKTSSEVCNADWMASLPPHLHNLPLSNLAIPGSHDSFSYWVDEKSPVGPDQTQAIKRLARISLVKKLMKKWSVTQNLTFREQLEAGIRYFDLRVSSKPGDADQEIYFIHGLFGIKVWDGLMEIDSFLTQHPQEIIFLDFNHFYAMDETHHKCLVLRIQEAFGNKLCPACSVESLTLRTLWEKNCQVLIFYHCPFYKQYPFLWPGKKIPAPWANTTSVRKLILFLETTLSERASRGSFHVSQAILTPRVKTIARGLVGGLKNTLVHRLALIPVYPLRFSRRS

SEQ ID NO: 14391 - protein, 305 aa, Homo sapiens
MLAVRKARRKLRMGTICSPNPSGTKTSSEVCNADWMASLPPHLHNLPLSNLAIPGSHDSFSYWVDEKSPVGPDQTQAIKRLARISLVKKLMKKWSVTQNLTFREQLEAGIRYFDLRVSSKPGDADQEIYFIHGLFGIKVWDGLMEIDSFLTQHPQEIIFLDFNHFYAMDETHHKCLVLRIQEAFGNKLCPACSVESLTLRTLWEKNCQVLIFYHCPFYKQYPFLWPGKKIPAPWANTTSVRKLILFLETTLSERASRGSFHVSQAILTPRVKTIARGLVGGLKNTLVHSNRWNSHGPSLLSQERS

SEQ ID NO: 14392 - protein, 321 aa, Homo sapiens
MASSQGKNELKLADWMATLPESMHSIPLTNLAIPGSHDSFSFYIDEASPVGPEQPETVQNFVSVFGTVAKKLMRKWLATQTMNFTGQLGAGIRYFDLRISTKPRDPDNELYFAHGLFSAKVNEGLEEINAFLTDHHKEVVFLDFNHFYGMQKYHHEKLVQMLKDIYGNKMCPAIFAQEVSLKYLWEKDYQVLVFYHSPVALEVPFLWPGQMMPAPWANTTDPEKLIQFLQASITERRKKGSFFISQVVLTPKASTVVKGVASGLRETITERALPAMMQWVRTQKPGESGINIVTADFVELGDFISTVIKLNYVFDEGEANT

SEQ ID NO: 14393 - protein, 321 aa, Homo sapiens; identical to SEQ ID NO: 14392

SEQ ID NO: 14394 - protein, 116 aa, Homo sapiens
MGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 14395 - protein, 204 aa, Homo sapiens
MRLSRRPETFLLAFVLLCTLLGLGCPLHCEICTAAGSRCHGQMKTCSSDKDTCVLLVGKATSKGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 14396 - protein, 839 aa, Homo sapiens
MRAKCITEPVGIELAPCLQAPSVPETDLKGVVQARGGGASVLEKPREGFKRAEQVPVSQTDCFVSLWLPTASQKKLRTRTISNCPNPEWNESFNFQIQSRVKNVLELSVCDEDTVTPDDHLLTVLYDLTKLCFRKKTHVKFPLNPQGMEELEVEFLLEESPSPPETLVTNGVLVSRQVSCLEVHAQSRRRRKREKMKDLLVMVNESFENTQRVRPCLEPCCPTSACFQTAACFHYPKYFQSQVHVEVPKSHWSCGLCCRSRKKGPISQPLDCLSDGQVMTLPVGESYELHMKSTPCPETLDVRLGFSLCPAELEFLQKRKVVVAKALKQVLQLEEDLQEDEVPLIAIMATGGGTRSMTSMYGHLLGLQKLNLLDCASYITGLSGATWTMATLYRDPDWSSKNLEPAIFEARRHVVKDKLPSLFPDQLRKFQEELRQRSQEGYRVTFTDFWGLLIETCLGDERNECKLSDQRAALSCGQNPLPIYLTINVKDDVSNQDFREWFEFSPYEVGLQKYGAFIPSELFGSEFFMGRLVKRIPESRICYMLGLWSSIFSLNLLDAWNLSHTSEEFFHRWTREKVQDIEDEPILPEIPKCDANILETTVVIPGSWLSNSFREILTHRSFVSEFHNFLSGLQLHTNYLQNGQFSRWKDTVLDGFPNQLTESANHLCLLDTAFFVNSSYPPLLRPERKADLIIHLNYCAGSQTKPLKQTCEYCTVQNIPFPKYELPDENENLKECYLMENPQEPDAPIVTFFPLINDTFRKYKAPGVERSPEELEQGQVDIYGPKTPYATKELTYTEATFDKLVKLSEYNILNNKDTLLQALRLAVEKKKRLKGQCPS

SEQ ID NO: 14397 - protein, 795 aa, Homo sapiens
MTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQKLMMSQRESLMSHAIELKSGSNKNIHIALATLALNYSVCFHKDHNIEGKAQCLSLISTILEVVQDLEATFRLLVALGTLISDDSNAVQLAKSLGVDSQIKKYSSVSEPAKVSECCRFILNLL

SEQ ID NO: 14398 - protein, 788 aa, Homo sapiens
MLCGRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDPWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYDRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 14399 - protein, 47 aa, Homo sapiens
MSQQKCIVIFALVCCFAILVALIFSAVDIMGEDEDGLSEKNCQNKCR

SEQ ID NO: 14400 - protein, 271 aa, Homo sapiens
MASKDAQNQRRGLPGFLPGAPDPDQSLPASSNPGNQAWQLSLPLPSSFLPTVSLPPGLEYLSQLDLIIIHQQVELLGMILGTETSNKYEIKNSLGQRIYFAVEESICFNRTFCSTLRSCTLRITDNSGREVITVNRPLRCNSCWCPCYLQELEIQAPPGTIVGYVTQKWDPFLPKFTIQNANKEDILKIVGPCVTCGCFGDVDFEVKTINEKLTIGKISKYWSGFVNDVFTNADNFGIHVPADLDVTVKAAMIGACFLFDFMFFEHSLAGL

SEQ ID NO: 14401 - protein, 271 aa, Homo sapiens; identical to SEQ ID NO: 14400

SEQ ID NO: 14402 - protein, 1010 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPRSLTYKESGVDIAAGNMLVKKIQPLAKATSRSGCKVDLGGFAGLFDLKAAGFKDPLLASGTDGVGTKLKIAQLCNKHDTIGQDLVAMCVNDILAQGAEPLFFLDYFSCGKLDLSVTEAVVAGIAKACGKAGCALLGGETAEMPDMYPPGEYDLAGFAVGAMERDQKLPHLERITEGDVVVGIASSGLHSNGFSLVRKIVAKSSLQYSSPAPDGCGDQTLGDLLLTPTRIYSHSLLPVLRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 14403 - protein, 1010 aa, Homo sapiens; identical to SEQ ID NO: 14402

SEQ ID NO: 14404 - protein, 1010 aa, Homo sapiens; identical to SEQ ID NO: 14402

SEQ ID NO: 14405 - protein, 330 aa, Homo sapiens
MELLSTPHSIEINNITCDSFRISWAMEDSDLERVTHYFIDLNKKENKNSNKFKHRDVPTKLVAKAVPLPMTVRGHWFLSPRTEYSVAVQTAVKQSDGEYLVSGWSETVEFCTGDYAKEHLAQLQEKAEQIAGRMLRFSVFYRNHHKEYFQHARTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSLGTLGEISGHQLMSLSTADAKKDPSCKTCNISVGR

SEQ ID NO: 14406 - protein, 237 aa, Homo sapiens
MELLSTPHSIEINNITCDSFRISWAMEDSDLERVTHYFIDLNKKENKNSNHHKEYFQHARTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSLGTLGEISGHQLMSLSTADAKKDPSCKTCNISVGR

SEQ ID NO: 14407 - protein, 330 aa, Homo sapiens; identical to SEQ ID NO: 14405

SEQ ID NO: 14408 - protein, 297 aa, Homo sapiens
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKSPLIRTPPSCTRSPWAGCWACGSQWRMPRWRTAVSGSSLAPTPVVCQEGWSGPLLAQRLVPASLGQSQPGITASLCPPQCREGPWSSSMEKWYTRASRTSLTARARPTLSTSWRPLAPPGARRTGSSQQLNCPFPNCTPKGSRRAGALAPPG

SEQ ID NO: 14409 - protein, 270 aa, Homo sapiens
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQQPHFGGEVSPHQDASFLYTEPLGRVLGVWIAVEDATLENGCLWFIPGSHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 14410 - protein, 291 aa, Homo sapiens
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKQPHFGGEVSPHQDASFLYTEPLGRVLGVWIAVEDATLENGCLWFIPGSHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 14411 - protein, 66 aa, Homo sapiens
MACLSPSQLQKFQQDGFLVLEGFLSAEECVAMQQRIGEIVAEMDVPLHCRTEFSTQEEEQLRAQGS

SEQ ID NO: 14412 - protein, 270 aa, Homo sapiens; identical to SEQ ID NO: 14409

SEQ ID NO: 14413 - protein, 177 aa, Homo sapiens
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKQPHFGGEVSPHQDASFLYTEPLGRVLGVWIAV

SEQ ID NO: 14414 - protein, 64 aa, Homo sapiens
MACLSPSQLQKFQQDGFLVLEGFLSAEECVAMQQRIGEIVAEMDVPLHCRTEFSTQEEEQLRAQ

SEQ ID NO: 14415 - protein, 592 aa, Homo sapiens
MASTSRDVIAGRGIHSKVKSAKLLEVLNAMEEEESNNNREEIFIAPPDNAAGEFTDEDSGDEDSQRGAHLPGSVLHASVLCEDSGTGEDNDDLELQPAKKRQKAVVKPQRIWTKRDIRPDFGSWTASDPHIEDLKSQELSPVGLFELFFDEGTINFIVNETNRYAWQKNVNLSLTAQELKCVLGILILSGYISYPRRRMFWETSPDSHHHLVADAIRRDRFELIFSYLHFADNNELDASDRFAKVRPLIIRMNCNFQKHAPLEEFYSFGESMCEYFGHRGSKQLHRGKPVRLGYKIWCGTTSRGYLVWFEPSQGTLFTKPDRSLDLGGSMVIKFVDALQERGFLPYHIFFDKVFTSVKLMSILRKKGVKATGTVREYRTERCPLKDPKELKKMKRGSFDYKVDESEEIIVCRWHDSSVVNICSNAVGIEPVRLTSRHSGAAKTRTQVHQPSLVKLYQEKVGGVGRMDQNIAKYKVKIRGMKWYSSFIGYVIDAALNNAWQLHRICCQDAQVDLLAFRRYIACVYLESNADTTSQGRRSRRLETESRFDMIGHWIIHQDKRTRCALCHSQTNTRCEKCQKGVHAKCFREYHIR

SEQ ID NO: 14416 - protein, 341 aa, Homo sapiens
MNCNFQKHAPLEEFYSFGESMCEYFGHRGSKQLHRGKPVRLGYKIWCGTTSRGYLVWFEPSQGTLFTKPDRSLDLGGSMVIKFVDALQERGFLPYHIFFDKVFTSVKLMSILRKKGVKATGTVREYRTERCPLKDPKELKKMKRGSFDYKVDESEEIIVCRWHDSSVVNICSNAVGIEPVRLTSRHSGAAKTRTQVHQPSLVKLYQEKVGGVGRMDQNIAKYKVKIRGMKWYSSFIGYVIDAALNNAWQLHRICCQDAQVDLLAFRRYIACVYLESNADTTSQGRRSRRLETESRFDMIGHWIIHQDKRTRCALCHSQTNTRCEKCQKGVHAKCFREYHIR

SEQ ID NO: 14417 - protein, 589 aa, Homo sapiens
MGRDVIAGRGIHSKVKSAKLLEVLNAMEEEESNNNREEIFIAPPDNAAGEFTDEDSGDEDSQRGAHLPGSVLHASVLCEDSGTGEDNDDLELQPAKKRQKAVVKPQRIWTKRDIRPDFGSWTASDPHIEDLKSQELSPVGLFELFFDEGTINFIVNETNRYAWQKNVNLSLTAQELKCVLGILILSGYISYPRRRMFWETSPDSHHHLVADAIRRDRFELIFSYLHFADNNELDASDRFAKVRPLIIRMNCNFQKHAPLEEFYSFGESMCEYFGHRGSKQLHRGKPVRLGYKIWCGTTSRGYLVWFEPSQGTLFTKPDRSLDLGGSMVIKFVDALQERGFLPYHIFFDKVFTSVKLMSILRKKGVKATGTVREYRTERCPLKDPKELKKMKRGSFDYKVDESEEIIVCRWHDSSVVNICSNAVGIEPVRLTSRHSGAAKTRTQVHQPSLVKLYQEKVGGVGRMDQNIAKYKVKIRGMKWYSSFIGYVIDAALNNAWQLHRICCQDAQVDLLAFRRYIACVYLESNADTTSQGRRSRRLETESRFDMIGHWIIHQDKRTRCALCHSQTNTRCEKCQKGVHAKCFREYHIR

SEQ ID NO: 14418 - protein, 593 aa, Homo sapiens
MPRTLSLHEITDLLETDDSIEASAIVIQPPENATAPVSDEESGDEEGGTINNLPGSLLHTAAYLIQDGSDAESDSDDPSYAPKDDSPDEVPSTFTVQQPPPSRRRKMTKILCKWKKADLTVQPVAGRVTAPPNDFFTVMRTPTEILELFLDDEVIELIVKYSNLYACSKGVHLGLTSSEFKCFLGIIFLSGYVSVPRRRMFWEQRTDVHNVLVSAAMRRDRFETIFSNLHVADNANLDPVDKFSKLRPLISKLNERCMKFVPNETYFSFDEFMVPYFGRHGCKQFIRGKPIRFGYKFWCGATCLGYICWFQPYQGKNPNTKHEEYGVGASLVLQFSEALTEAHPGQYHFVFNNFFTSIALLDKLSSMGHQATGTVRKDHIDRVPLESDVALKKKERGTFDYRIDGKGNIVCRWNDNSVVTVASSGAGIHPLCLVSRYSQKLKKKIQVQQPNMIKVYNQFMGGVDRADENIDKYRASIRGKKWYSSPLLFCFELVLQNAWQLHKTYDEKPVDFLEFRRRVVCHYLETHGHPPEPGQKGRPQKRNIDSRYDGINHVIVKQGKQTRCAECHKNTTFRCEKCDVALHVKCSVEYHTE

SEQ ID NO: 14419 - protein, 593 aa, Homo sapiens; identical to SEQ ID NO: 14418

SEQ ID NO: 14420 - protein, 585 aa, Homo sapiens
MSNPRKRSIPMRDSNTGLEQLLAEDSFDESDFSEIDDSDNFSDSALEADKIRPLSHLESDGKSSTSSDSGRSMKWSARAMIPRQRYDFTGTPGRKVDVSDITDPLQYFELFFTEELVSKITRETNAQAALLASKPPGPKGFSRMDKWKDTDNDELKVFFAVMLLQGIVQKPELEMFWSTRPLLDTPYLRQIMTGERFLLLFRCLHFVNNSSISAGQSKAQISLQKIKPVFDFLVNKFSTVYTPNRNIAVDESLMLFKGPLAMKQYLPTKRVRFGLKLYVLCESQSGYVWNALVHTGPGMNLKDSADGLKSSRIVLTLVNDLLGQGYCVFLDNFNISPMLFRELHQNRTDAVGTARLNRKQIPNDLKKRIAKGTTVARFCGELMALKWCDGKEVTMLSTFHNDTVIEVNNRNGKKTKRPRVIVDYNENMGAVDSADQMLTSYPSERKRHKVWYKKFFHHLLHITVLNSYILFKKDNPEHTMSHINFRLALIERMLEKHHKPGQQHLRGRPCSDDVTPLRLSGRHFPKSIPATSGKQNPTGRCKICCSQYDKDGKKIRKETRYFCAECDVPLCVVPCFEIYHTKKNY

SEQ ID NO: 14421 - protein, 315 aa, Homo sapiens
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEDDLLIEVSEKYRLHLNLPKLIDTEMTTAKFIKEKSTLIITMPLV

SEQ ID NO: 14422 - protein, 288 aa, Homo sapiens
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEGTTEPQALAKDELSLKF

SEQ ID NO: 14423 - protein, 288 aa, Homo sapiens; identical to SEQ ID NO: 14422

SEQ ID NO: 14424 - protein, 315 aa, Homo sapiens; identical to SEQ ID NO: 14421

SEQ ID NO: 14425 - protein, 211 aa, Homo sapiens
MSHGHSHGGGGCRCAAEREEPPEQRGLAYGLYLRIDLERLQCLNESREGSGRGVFKPWEERTDRSKFVESDADEELLFNIPFTGNVKLKGIIIMGEDDDSHPSEMRLYKNIPQMSFDDTEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 14426 - protein, 98 aa, Homo sapiens
MSFDDTEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 14427 - protein, 70 aa, Homo sapiens
MGEDDDSHPSEMRLYKNIPQMSFDDTEREPDQTFSLNRDLTGELEYATKISRFSNVYHLSIHISKNFGAD

SEQ ID NO: 14428 - protein, 1037 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFVNNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTISVSFLLPDITDTFEAFTLSLLSSLLTSGPNSPFYKALIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 14429 - protein, 1030 aa, Homo sapiens
MRNVALRRAAGPVCAEAAERRTCTPQSVAMEQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTISVSFLLPDITDTFEAFTLSLLSSLLTSGPNSPFYKALIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 14430 - protein, 1038 aa, Homo sapiens
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTISVSFLLPDITDTFEAFTLSLLSSLLTSGPNSPFYKALIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQVGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 14431 - protein, 595 aa, Homo sapiens
MWKSSFQYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 14432 - protein, 86 aa, Homo sapiens
VNATPQQMPQTEKAVEDFLRSIGRSKKERRPVRPHTVEKPVPSSSGGDAHVPHGSQVIRKLVMYTLRHHVKIGGLHVSFTVRNCVE

SEQ ID NO: 14433 - protein, 233 aa, Homo sapiens
  MOD_RES (1)..(1): Any amino acid
XLIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTGHCERYAFPGSRVPWGN

SEQ ID NO: 14434 - protein, 939 aa, Homo sapiens
MRNVALRRAAGPVCAEAAERRVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTISVSFLLPDITDTFEAFTLSLLSSLLTSGPNSPFYKALIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 14435 - protein, 259 aa, Homo sapiens
  MOD_RES (1)..(1): Any amino acid
XFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHARKRPVCGSGDLGLISPRASSRSLCLCCRPSHHCLPRLLSEVDVF

SEQ ID NO: 14436 - protein, 184 aa, Homo sapiens
KPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGILSITVRISTHSLTDDVAVFQVPGMHGQEH

SEQ ID NO: 14437 - protein, 177 aa, Homo sapiens
MNWFGSNFFRCPEDLSLLNIYSPLLSHMSSEDEHFISNLRGHVPASAVVKQPVRGASGRTTITAIVQTGGGWSTGLFSVCRDRRICFCGLFCPMCLECDIARHYGECLCWPLLPGSTFALRIGTRERHKIQGTLCEDWLAVHCCWAFSICQVARELKMRTSQVYEICAVPMTKDTLV

SEQ ID NO: 14438 - protein, 115 aa, Homo sapiens
MQAQAPVVVVTQPGVGPGPAPQNSNWQTGMCDCFSDCGVCLCGTFCFPCLGCQVAADMNECCLCGTSVAMRTLYRTRYGIPGSICDDYMATLCCPHCTLCQIKRDINRRRAMRTF

SEQ ID NO: 14439 - protein, 115 aa, Homo sapiens; identical to SEQ ID NO: 14438

SEQ ID NO: 14440 - protein, 115 aa, Homo sapiens; identical to SEQ ID NO: 14438

SEQ ID NO: 14441 - protein, 115 aa, Homo sapiens; identical to SEQ ID NO: 14438

SEQ ID NO: 14442 - protein, 630 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 14443 - protein, 1282 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRITFNFRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQMKENEPIITMVHTMIENSALRPQLYQQFLRQKSKISLYCLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14444 - protein, 76 aa, Homo sapiens
MAADLNLEWISLPRSWTYGITRGGRVFFINEEAKSTTWLHPVTGEAVVTGHRRQSTDLPTGWEEAYTFEGARYYIN

SEQ ID NO: 14445 - protein, 793 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTRFENLAAEEAGLEDSPDSGWRLCLRLHGPLHPEGLSPDGHELPFLFEQAHALLLRGRPPPPDDTLRALAALRLQSLQRDFSPRVPLPRLDRLLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARYDVLELSTEPGRGAPQKLCLGLGAKAMSLSRPGETEPIHSVSYGHVAACQLMGPHTLALRVGESQLLLQSPQVEEIMQLVNAYLANPSPERPCSSSSPPCQDLPDTSPPSQRPGLDEPQGQSGCLGQLQD

SEQ ID NO: 14446 - protein, 149 aa, Homo sapiens
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRASYEFMRRSLIFYRNEIRKVTGKDPLEQFGISEEARFQLSGLQA

SEQ ID NO: 14447 - protein, 1116 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14448 - protein, 650 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTWGREKVATATGAAEAVASDTHLPRTGSSSPSLLCV

SEQ ID NO: 14449 - protein, 1179 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14450 - protein, 1174 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14451 - protein, 1060 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14452 - protein, 320 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEKKKKKKKK

SEQ ID NO: 14453 - protein, 1105 aa, Homo sapiens
MTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTMKENEPIITMVHTMIENSALRPQLYQQFLRQKSKISLYCLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14454 - protein, 1174 aa, Homo sapiens; identical to SEQ ID NO: 14450

SEQ ID NO: 14455 - protein, 397 aa, Homo sapiens
YTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14456 - protein, 874 aa, Homo sapiens
MRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14457 - protein, 1184 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRIFFSDFRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQMKENEPIITMVHTMIENSALRPQLYQQFLRQKSKISLYCLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMD

SEQ ID NO: 14458 - protein, 1098 aa, Homo sapiens
MTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTMKENEPIITMVHTMIENSALRPQLYQQLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 14459 - protein, 1048 aa, Homo sapiens
MSNKTGGKRPATTNSDIPNHNMVSEVPPERPSVRATRTARKAVAFGKRSHSMKRNPNAPVTKAGWLFKQASSGVKQWNKRWFVLVDRCLFYYKDEKEESILGSIPLLSFRVAAVQPSDNISRKHTFKAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKVGVVPPRTKSPTDDEVTPSAVVRRNASGLTNGLSSQERPKSAVFPGEGKVKMSVEEQIDRMRRHQSGSMREKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSVQCATPSPPTSPASPAPPANPLSSESPRGADSSYTMRV

SEQ ID NO: 14460 - protein, 106 aa, Homo sapiens
RARIYSPVRSPSARFERLPPRSEDIYADPAAYVMRRSISSPKYDYLGDRRPVPAGLFPYNYPPSPTVHDKMVPPYPEVFRDSLHTYKLNEQDTDKLLGKLCEQNKV

SEQ ID NO: 14461 - protein, 1068 aa, Homo sapiens
MSNKTGGKRPATTNSDIPNHNMVSEVPPERPSVRATRTARKAVAFGKRSHSMKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKVGVVPPRTKSPTDDEVTPSAVVRRNASGLTNGLSSQERPKSAVFPGEGKVKMSVEEQIDRMRRHQSGSMREKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSVQCATPSPPTSPASPAPPANPLSSESPRGADSSYTMRV

SEQ ID NO: 14462 - protein, 104 aa, Homo sapiens
RARIYSPVRSPSARFERLPPRSEDIYADPAAYVMRRSISSPKMSESETLISMVNRMVENSSPRSQLFMQVPPYPEVFRDSLHTYKLNEQDTDKLLGKLCEQNKV

SEQ ID NO: 14463 - protein, 151 aa, Homo sapiens
RARIYSPVRSPSARFERLPPRSEDIYADPAAYVMRRSISSPKYDYLGDRRPVPAGLFPYNYPPSPTVHDKMDELLDLQLQRNLEYLDQQMSESETLISMVNRMVENSSPRSQLFMQVPPYPEVFRDSLHTYKLNEQDTDKLLGKLCEQNKV

SEQ ID NO: 14464 - protein, 124 aa, Homo sapiens
RARIYSPVRSPSARFERLPPRSEDIYADPAAYVMRRSISSPKYDYLGDRRPVPAGLFPYNYPPSPTVHDKMDELLDLQLQRNLEYLDQQVPPYPEVFRDSLHTYKLNEQDTDKLLGKLCEQNKV

SEQ ID NO: 14465 - protein, 83 aa, Homo sapiens
RARIYSPVRSPSARFERLPPRSEDIYADPAAYVMRRSISSPKYDYLGDRRPVPAGLFPYNYPPSPTVHDKMKLLGKLCEQNKV

SEQ ID NO: 14466 - protein, 133 aa, Homo sapiens
RARIYSPVRSPSARFERLPPRSEDIYADPAAYVMRRSISSPKYDYLGDRRPVPAGLFPYNYPPSPTVHDKMMSESETLISMVNRMVENSSPRSQLFMQVPPYPEVFRDSLHTYKLNEQDTDKLLGKLCEQNKV

SEQ ID NO: 14467 - protein, 221 aa, Homo sapiens
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEAYGYGPYGGAYPPGTQVVYAANGQAYAVPYQYPYAGLYGQQPANQVIIRERYRDNDSDLALGMLAGAATGMALGSLFWVF

SEQ ID NO: 14468 - protein, 309 aa, Homo sapiens
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEELHSKGPKIHTTTSAKTQAVLPTRCFFPSESPIRRSVQISVLLPAVNIRRRIKLTFPQPARPRAPRSLCLWQTWFAGKRAPSLPTAATAPALPSCPSPPAPSQALPPSLAGWRSPSSAPLPPEQALAPRSFQLSKHQARPRPHRPGTPPVPAWPGVPPPPPARPPALR

SEQ ID NO: 14469 - protein, 222 aa, Homo sapiens
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAGLYGQQPANQVIIRERYRDNDSDLALGMLAGAATGMALGSLFWVF

SEQ ID NO: 14470 - protein, 309 aa, Homo sapiens; identical to SEQ ID NO: 14468

SEQ ID NO: 14471 - protein, 222 aa, Homo sapiens; identical to SEQ ID NO: 14469

SEQ ID NO: 14472 - protein, 222 aa, Homo sapiens; identical to SEQ ID NO: 14469

SEQ ID NO: 14473 - protein, 178 aa, Homo sapiens
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEDFMDSSLLTKSSFESAIETTTATWHWACWQEQPRAWP

SEQ ID NO: 14474 - protein, 170 aa, Homo sapiens
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLLMAMGHTVVRTRQELKLSTLRMGRRMPCPTSTHMQDFMDSSLLTKSSFESAIETTTATWHWACWQEQPRAWP

SEQ ID NO: 14475 - protein, 174 aa, Homo sapiens
MPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAGLYGQQPANQVIIRERYRDNDSDLALGMLAGAATGMALGSLFWVF

SEQ ID NO: 14476 - protein, 506 aa, Homo sapiens
MFTSKSNSVSPSPSLEQADSDALDISTKVQLYGVLWKRPFGRPSAKWSRRFFIIKESFLLYYSESEKKSFETNKYFNIHPKGVIPLGGCLVEPKEEPSMPYAMKISHQDFHGNILLAAESEFEQTQWLEMLQESGKVTWKNAQLGEAMIKSLEAQGLQLAKEKQEYLDKLMEETEELCLQREQREELERLNQVLEAEKQQFEEVVQELRMEQEQIKRELELTARCLKGVEQEKKELRHLTESLQQTLEELSIEKKKTLEMLEENENHLQTLANQSEQPPPSGGLHSNLRQIEEKMQQLLEEKLLAEKRMKENEERSRALEEEREFYSSQSQALQNSLQELTAEKQQAERELKAEVKVRMDLERRLREAEGALRSLEQGLNSKVRNKEKEERMRADVSHLKRFFEECIRNAELEAKMPVIMKNSVYIHKAATRRIKSCRFHRRRSSTSWNDMKPSQSFMTSQLDANNMEELKEVAKRLSRDQRFRESIYHIMATQPGAPSALSRGGK

SEQ ID NO: 14477 - protein, 1385 aa, Homo sapiens
MELSDSDRPVSFGSTSSSASSRDSHGSFGSRMTLVSNSHMGLFNQDKEVGAIKLELIPARPFSSSELQRDNPATGQQNADEGSERPPRAQWRVDSNGAPKTIADSATSPKLLYVDRVVQEILETERTYVQDLKSIVEDYLDCIRDQTKLPLGTEERSALFGNIQDIYHFNSELLQDLENCENDPVAIAECFVSKSEEFHIYTQYCTNYPRSVAVLTECMRNKILAKFFRERQETLKHSLPLGSYLLKPVQRILKYHLLLHEIENHLDKDTEGYDVVLDAIDTMQRVAWHINDMKRKHEHAVRLQEIQSLLTNWKGPDLTSYGELVLEGTFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYRLRRKSEPSSRSHKVLKTSETAQDIQKVSREEGSPQLSSARPSPAQRNSQPSSSTMISVLRAGGALRNIWTDHQIRQALFPSRRSPQENEDDEDDYQMFVPSFSSSDLNSTRLCEDSTSSRPCSWHMGQMESTETSSSGHRIVRRASSAGESNTCPPEIGTSDRTRELQNSPKTEGQEEMTPFGSSIELTIDDIDHVYDNISYEDLKLMVAKREEAESTPSKSARDSVRPKSTPELAFTKRQAGHSKGSLYAQTDGTLSGGEASSQSTHELQAVEENIYDTIGLPDPPSLGFKCSSLKRAKRSTFLGLEADFVCCDSLRPFVSQDSLQLSEDEAPYHQATPDHGYLSLLYDSPSGNLSMPHKPVSDKLSEEVDEIWNDLENYIKKNEDKARDRLLAAFPVSKDDVPDRLHAESTPELSRDVGRSVSTLSLPESQALLTPVKSRAGRASRANCPFEEDLISKEGSFMSLNRLSLASEMPLMDNPYDLANSGLSQTDPENPDLGMEATDKTKSRVFMMARQYSQKIKKANQLLKVKSLELEQPPASQHQKSMHKDLAAILEEKKQGGPAIGARIAEYSQLYDQIVFRESPLKIQKDGWASPQESSLLRSVSPSQVHHGSGDWLLHSTYSNGELADFCLPPEQDLRSRYPTFEINTKSTPRQLSAACSVPSLQTSDPLPGSVQRCSVVVSQPNKENWCQDHLYNSLGRKGISAKSQPYHRSQSSSSVLINKSMDSINYPSDVGKQQLLSLHRSSRCESHQDLLPDIADSHQQGTEKLSDLTLQDSQKVVVVNRNLPLNAQIATQNYFSNFKETDGDEDDYVEIKSEEDESELELSHNRRRKSDSKFVDADFSDNVCSGNTLHSLNSPRTPKKPVNSKLGLSPYLTPYNDSDKLNDYLWRGPSPNQQNIVQSLREKFQCLSSSSFA

SEQ ID NO: 14478 - protein, 46 aa, Homo sapiens
MELSDSDRPVSFGSTSSSASSRDSHGSFGSRMTLVSNSHMGLFNQD

SEQ ID NO: 14479 - protein, 1385 aa, Homo sapiens; identical to SEQ ID NO: 14477

SEQ ID NO: 14480 - protein, 952 aa, Homo sapiens
MELSDSDRPVSFGSTSSSASSRDSHGSFGSRMTLVSNSHMGLFNQDKEVGAIKLELIPARPFSSSELQRDNPATGQQNADEGSERPPRAQWRVDSNGAPKTIADSATSPKLLYVDRVVQEILETERTYVQDLKSIVEDYLDCIRDQTKLPLGTEERSALFGNIQDIYHFNSELLQDLENCENDPVAIAECFVSKSEEFHIYTQYCTNYPRSVAVLTECMRNKILAKFFRERQETLKHSLPLGSYLLKPVQRILKYHLLLHEIENHLDKDTEGYDVVLDAIDTMQRVAWHINDMKRKHEHAVRLQEIQSLLTNWKGPDLTSYGELVLEGTFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYRLRRKSEPSSRSHKVLKTSETAQDIQKVSREEGSPQLSSARPSPAQRNSQPSSSTMISVLRAGGALRNIWTDHQIRQALFPSRRSPQENEDDEDDYQMFVPSFSSSDLNSTRLCEDSTSSRPCSWHMGQMESTETSSSGHRIVRRASSAGESNTCPPEIGTSDRTRELQNSPKTEGQEEMTPFGSSIELTIDDIDHVYDNISYEDLKLMVAKREEAESTPSKSARDSVRPKSTPELAFTKRQAGHSKGSLYAQTDGTLSGGEASSQSTHELQAVEENIYDTIGLPDPPSLGFKCSSLKRAKRSTFLGLEADFVCCDSLRPFVSQDSLQLSEDEAPYHQATPDHGYLSLLYDSPSGNLSMPHKPVSDKLSEEVDEIWNDLENYIKKNEDKARDRLLAAFPVSKDDVPDRLHAESTPELSRDVGRSVSTLSLPESQALLTPVKSRAGRASRANCPFEEDLISKEGSFMSLNRLSLASEMTLCQALCRDAAW

SEQ ID NO: 14481 - protein, 1163 aa, Homo sapiens
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVESQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 14482 - protein, 1219 aa, Homo sapiens
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNSDPVAVASCFVERSQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 14483 - protein, 161 aa, Homo sapiens
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNS

SEQ ID NO: 14484 - protein, 188 aa, Homo sapiens
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNSDPVAVASCFVERSQEFDIYTQYCNNYP

SEQ ID NO: 14485 - protein, 1271 aa, Homo sapiens
MEALRNPMPLGSSEEALGDLACSSLTGASRDLGTGAVASGTQEETSGPRGDPQQTPSLEKERHTPSRTGPGAAGRTLPRRSRSWERAPRSSRGAQAAACHTSHHSAGSRPGGHLGGQAVGTPNCVPVEGPGCTKEEDVLASSACVSTDGGSLHCHNPSGPSDVPARQPHPEQEGWPPGTGDFPSQVPKQVLDVSQELLQSGVVTLPGTRDRHGRAVVQVRTRSLLWTREHSSCAELTRLLLYFHSIPRKEVRDLGLVVLVDARRSPAAPAVSQALSGLQNNTSPIIHSILLLVDKESAFRPDKDAIIQCEVVSSLKAVHKFVDSCQLTADLDGSFPYSHGDWICFRQRLEHFAANCEEAIIFLQNSFCSLNTHRTPRTAQEVAELIDQHETMMKLVLEDPLLVSLRLEGGTVLARLRREELGTEDSRDTLEAATSLYDRVDEEVHRLVLTSNNRLQQLEHLRELASLLEGNDQQSCQKGLQLAKENPQRTEEMVQDFRRGLSAVVSQAECREGELARWTRSSELCETVSSWMGPLDPEACPSSPVAECLRSCHQEATSVAAEAFPGAGVAVLKPHALGKPWASQQDLWLQYPQTRLRLEEALSEAAPDPSLPPLAQSPPKHERAQEAMRRHQKPPSFPSTDSGGGAWEPAQPLSGLPGRALLCGQDGETLRPGLCALWDPLSLLRGLPGAGATTAHLEDSSACSSEPTQTLASRPRKHPQKKMIKKTQSFEIPQPDSGPRDSCQPDHTSVFSKGLEVTSTVATEKKLPLWQHARSPPVTQSRSLSSPSGLHPAEEDGRQQVGSSRLRHIMAEMIATEREYIRCLGYVIDNYFPEMERMDLPQGLRGKHHVIFGNLEKLHDFHQQHFLRELERCQHCPLAVGRSFLRHEEQFGMYVIYSKNKPQSDALLSSHGNAFFKDKQRELGDKMDLASYLLRPVQRVAKYALLLQDLLKEASCGLAQGQELGELRAAEVVVCFQLRHGNDLLAMDAIRGCDVNLKEQGQLRCRDEFIVCCGRKKYLRHVFLFEDLILFSKTQKVEGSHDVYLYKQSFKTAEIGMTENVGDSGLRFEIWFRRRRKSQDTYILQASSAEVKSAWTDVIGRILWRQALKSRELRIQEMASMGIGNQPFMDVKPRDRTPDCAVISDRAPKCAVMSDRVPDSIVKGTESQMRGSTAVSSSDHAAPFKRPHSTISDSSTSSSSSQSSSILGSLGLLVSSSPAHPGLWSPAHSPWSSDIRACVEEDEPEPELETGTQAAVCEGAPAVLLSRTRQA

SEQ ID NO: 14486 - protein, 379 aa, Homo sapiens
MIFMNTLRYLQTHEYLLDVDLWRLFANLEELTQTSLGFVNSLFGIIKDYVDASEISSSLDFISVLTKYFRGSLCQSHQTYCLNYSAAIFYLESLRQRDDFGIYLKWCEQNEQCRRLHVPELLVAPLQRLTRYPLLLKNIWKRSMDSAEKIMIYSIKEKVEKSIRDLEGKVKWLDNFQKFRYLQEIIVWPPLWDRDKRFFIPECLKHIFKEHMAENILSPTSRHLLYEGKLTLAESTRFLDVYLFLFNDFLLVTKTKCNKKKLGGSDPGLMCPSLTPELQAVIKEGGSCTVLDQPIPLDRLVVKSIEPLHVSVFGLRNAFLIQHENRYRQCIAAFLLQAQTENIKKTWMAQITTAISCFTKSQETKKISLFTLPAESSEI

SEQ ID NO: 14487 - protein, 1364 aa, Homo sapiens
MAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKIAEATFIMASYMNHCTTTVNPPTNPPGACQLWELDGRQFFSSVSCATKGPTLL

SEQ ID NO: 14488 - protein, 329 aa, Homo sapiens
MAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKPQHHAVLSWVLTCSSLPCSSPQGRADSSLRANQSRTLGLLFSEGHCASERISRPTGAHTTGPLNSTVMIPFGYFLPDCRSYLHHGQLYEPLHYNCEPPHQPTRSLPAVGTGWTTVLFFCFLCYQGANVAVNISPTRFPNTTSASGFRDIYPRV

SEQ ID NO: 14489 - protein, 793 aa, Homo sapiens; identical to SEQ ID NO: 14445

SEQ ID NO: 14490 - protein, 616 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTSLAAEEAGLEDSPDSGWRLCLRLHGPLHPEGLSPDGHELPFLFEQPDSASLSAGAWSGYGHVAACQLMGPHTLALRVGESQLLLQSPQVEEIMQLVNAYLANPSPERPCSSSSPPCQDLPDTSPPSQRPGLDEPQGQSGCLGQLQD

SEQ ID NO: 14491 - protein, 364 aa, Homo sapiens
MSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTSLAAEEAGLEDSPDSGWRLCLRLHGPLHPEGLSPDGHELPFLFEQAHALLLRGRPPPPDDTLRALAALRLQSLQRDFSPRVPLPRLDRLLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARSLVGVLHRSCAWAWEPRPCPSPGQGRRSPSTVSAMAMWPPAS

SEQ ID NO: 14492 - protein, 149 aa, Homo sapiens; identical to SEQ ID NO: 14446

SEQ ID NO: 14493 - protein, 999 aa, Homo sapiens
MEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 14494 - protein, 717 aa, Homo sapiens
MEALEVDDISPALEVTEEFFSTLDSNLEKAVQQAEVYGIQEVPELVGHEVLSNITDNGAMRNVTSLGKGGMIWDHCKSRLLETKAQNVFPAKEQFMVQRGTTPDNLSWMEQKEASTFNFFNICQRRRDRPRSVNDLLDETSTFKPGHARSRSDITQVDWRVVLKTTPLQQQQQQQPLLQGPHVTRPSFLLPSPNKIEDAQGNTEHKQTFPNILKKGYLEIRKDHDSYWQSCYAELSPYNLYFYSLDSSGNQNLYATYQLSHFQSISVLGNLEARMVDTVLYDNTQLQLKAESPWEALDWGQKLWEVVHAAVPGYMGRQNELTISPGLGHHDDYTQNHSFQKKTSGLLPPSPVLDSSKQYQNILKSGTLYRLTVQNNWKAFTFVLSRAYLMAFQPGKLDEDPLLSYNVDVCLAVQMDNLDGCDSCFQVIFPQDVLRLRAETRQRAQEWMEALKIAANVARSSEQNLQVTLRNKPKDQMGGHELRKNKRQSVTTSFLSILTTLSLERGLTAQSFKCAGCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRIFPREYLLQQIHLYSLADLQQVIEGKLAPFLGKVIKFATSHVYSCSLCSQKGFICEICNNGEILYPFEDISTSRFGDPYADLLQGYVA

SEQ ID NO: 14495 - protein, 761 aa, Homo sapiens
MEALEVDDISPALEVTEEFFSTLDSNLEKAVQQAEVYGIQEVPELVGHEVLSNITDNGAMRNVTSLGKGGMIWDHCKSRLLETKAQNVFPAKEQFMVQRGTTPDNLSWMEQKEASTFNFFNICQRRRDRPRSVNDLLDETSTFKPGHARSRSDITQVDWRVVLKTTPLQQQQQQQPLLQGPHVTRPSFLLPSPNKIEDAQGNTEHKQTFPNILKKGYLEIRKDHDSYWQSCYAELSPYNLYFYSLDSSGNQNLYATYQLSHFQSISVLGNLEARMVDTVLYDNTQLQLKAESPWEALDWGQKLWEVVHAAVPGYMGRQNELTISPGLGHHDDYTQNHSFQKKTSGLLPPSPVLDSSKQYQNILKSGTLYRLTVQNNWKAFTFVLSRAYLMAFQPGKLDEDPLLSYNVDVCLAVQMDNLDGCDSCFQVIFPQDVLRLRAETRQRAQEWMEALKIAANVARSSEQNLQVTLRNKPKDQMGGHELRKNKRQSVTTSFLSILTTLSLERGLTAQSFKCAGCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRIFPREYLLQQIHLYSLADLQQVIEGKLAPFLGKVIKFATSHVYSCSLCSQKGFICEICNNGEILYPFEDISTSRCESCGAVFHSECKEKSVPCPRCVRRELQKKQKSFWQRLNMDESLEEACTMFELSYQNT

SEQ ID NO: 14496 - protein, 469 aa, Homo sapiens
  MOD_RES (1)..(1): Any amino acid
XNQNLYATYQLSHFQSISVLGNLEARMVDTVLYDNTQLQLKAESPWEALDWGQKLWEVVHAAVPGYMGRQNELTISPGLGHHDDYTQNHSFQKKTSGLLPPSPVLDSSKQYQNILKSGTLYRLTVQNNWKAFTFVLSRAYLMAFQPGKLDEDPLLSYNVDVCLAVQMDNLDGCDSCFQVIFPQDVLRLRAETRQRAQEWMEALKIAANVARSSEQNLQVTLRNKPKDQMGGHELRKNKRQSVTTSFLSILTTLSLERGLTAQSFKCAGCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRIFPREYLLQQIHLYSLADLQQVIEGKLAPFLGKVIKFATSHVYSCSLCSQKGFICEICNNGEILYPFEDISTSRFGDPYADLLQGYVA

SEQ ID NO: 14497 - protein, 576 aa, Homo sapiens
MGNSHCVPQAPRRLRASFSRKPSLKGNREDSARMSAGLPGPEAARSGDAAANKLFHYIPGTDILDLENQRENLEQPFLSVFKKGRRRVPVRNLGKVVHYAKVQLRFQHSQDVSDCYLELFPAHLYFQAHGSEGLTFQGLLPLTELSVCPLEGSREHAFQITGPLPAPLLVLCPSRAELDRWLYHLEKQTALLGGPRRCHSAPPQGSCGDELPWTLQRRLTRLRTASGHEPGGSAVCASRVKLQHLPAQEQWDRLLVLYPTSLAIFSEELDGLCFKGELPLRAVHINLEEKEKQIRSFLIEGPLINTIRVVCASYEDYGHWLLCLRAVTHREGAPPLPGAESFPGSQVMGSGRGSLSSGGQTSWDSGCLAPPSTRTSHSLPESSVPSTVGCSSQHTPLHRLSLESSPDAPDHTSETSHSPLYADPYTPPATSHRRVTDVRGLEEFLSAMQSARGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 14498 - protein, 663 aa, Homo sapiens
MGNSHCVPQAPRRLRASFSRKPSLKGNREDSARMSAGLPGPEAARSGDAAANKLFHYIPGTDILDLENQRENLEQPFLSVFKKGRRRVPVRNLGKVVHYAKVQLRFQHSQDVSDCYLELFPAHLYFQAHGSEGLTFQGLLPLTELSVCPLEGSREHAFQITGVWDASRAPRGTPDPGLGEGPALWLRSTCVYVCALSALPAGPLPAPLLVLCPSRAELDRWLYHLEKQTALLGGPRRCHSAPPQGSCGDELPWTLQRRLTRLRTASGHEPGGSAVCASRVKLQHLPAQEQWDRLLVLYPTSLAIFSEELDGLCFKGELPLRAVHINLEEKEKQIRSFLIEGPLINTIRVVCASYEDYGHWLLCLRAVTHREGAPPLPGAESFPGSQVMGSGRGSLSSGGQTSWDSGCLAPPSTRTSHSLPESSVPSTVGCSSQHTPDQANSDRASIGRRRTELRRSGSSRSPGSKARAEGRGPVTPLHLDLTQLHRLSLESSPDAPDHTSETSHSPLYADPYTPPATSHRRVTDVRGLEEFLSAMQSARGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 14499 - protein, 611 aa, Homo sapiens
MGNSHCVPQAPRRLRASFSRKPSLKGNREDSARMSAGLPGPEAARSGDAAANKLFHYIPGTDILDLENQRENLEQPFLSVFKKGRRRVPVRNLGKVVHYAKVQLRFQHSQDVSDCYLELFPAHLYFQAHGSEGLTFQGLLPLTELSVCPLEGSREHAFQITGPLPAPLLVLCPSRAELDRWLYHLEKQTALLGGPRRCHSAPPQRRLTRLRTASGHEPGGSAVCASRVKLQHLPAQEQWDRLLVLYPTSLAIFSEELDGLCFKGELPLRAVHINLEEKEKQIRSFLIEGPLINTIRVVCASYEDYGHWLLCLRAVTHREGAPPLPGAESFPGSQVMGSGRGSLSSGGQTSWDSGCLAPPSTRTSHSLPESSVPSTVGCSSQHTPDQANSDRASIGRRRTELRRSGSSRSPGSKARAEGRGPVTPLHLDLTQLHRLSLESSPDAPDHTSETSHSPLYADPYTPPATSHRRVTDVRGLEEFLSAMQSARGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 14500 - protein, 490 aa, Homo sapiens
MEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEVASAASDGLLRLDLDVPDSGPPVFAPSNHVSEAQPRETPRPLMPPTKPFLAPETTSPGDRVETPVGERAPTPVSASSEVSPESQEDSETPAEEDSGSEQPPNSVLPDKLKVSWENPSPQEAPAAESAEPSQAPCSETSEAAPREGGKPPTPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 14501 - protein, 223 aa, Homo sapiens [sequence omitted]

SEQ ID NO: 14502 - protein, 640 aa, Homo sapiens
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALTRVALMEQRVKELQRQRKELRIEMEVEVALLRGELAGERVAARREEEQLRELLEQQAASEQRGRQQREQEQRRLSQERDRLEGLRQRLRKAQGQLDSQPEDQRERLLQGVQEMREQLDVAQRAYEDLEFQQLERESRQEEEDRDSPGPQVPDPKVQELQASMAQHRRGALQHRIRVLEEQLKSLGEQMAAESRGLSRKKEEALQALSQERSRLLELNCLQGTPGGDFSEPNPALTKLLFTQKTDRQLLVLQDAVAHSAATPTSSCLFSVHSSLQGSIGLQRTGSLPRKRGERGSQRGSPRPLSFHCTESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 14503 - protein, 175 aa, Homo sapiens
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWCEAQRCRVQQRCSLCVQAGGQRGSEETQALPVSMAGSPSPLPGSPGAQEGGV

SEQ ID NO: 14504 - protein, 220 aa, Homo sapiens
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPACNGTPCGAMCRNRRPRTSSWQMPSWQGGGRWRSCSYRSRPSSRPGRCEAQRCRVQQRCSLCVQAGGQRGSEETQALPVSMAGSPSPLPGSPGAQEGGV

SEQ ID NO: 14505 - protein, 669 aa, Homo sapiens
MAHHLPAAMESHQDFRSIKAKFQASQPEPSDLPKKPPKPEFGKLKKFSQPELSEHPKKAPLPEFGAVSLKPPPPEVTDLPKKPPPPEVTDLPKKPPPPEVTDLPKKPPPPEVTDLPKKPSKLELSDLSKKFPQLGATPFPRKPLQPEVGEAPLKASLPEPGAPARKPLQPDELSHPARPPSEPKSGAFPRKLWQPEAGEATPRSPQPELSTFPKKPAQPEFNVYPKKPPQPQVGGLPKKSVPQPEFSEAAQTPLWKPQSSEPKRDSSAFPKKASQPPLSDFPKKPPQPELGDLTRTSSEPEVSVLPKRPRPAEFKALSKKPPQPELGGLPRTSSEPEFNSLPRKLLQPERRGPPRKFSQPEPSAVLKRHPQPEFFGDLPRKPPLPSSASESSLPAAVAGFSSRHPLSPGFGAAGTPRWRSGGLVHSGGARPGLRPSHPPRRRPLPPASSLGHPPAKPPLPPGPVDMQSFRRPSAASIDLRRTRSAAGLHFQDRQPEDIPVPDEIYELYDDVEPRDDSSPSPKGRDEAPSVQQAARRPPQDPALRKEKDPQPQQLPPMDPKLLKQLRKAEKAEREFRKKFKFEGEIVVHTKMMIDPNAKTRRGGGKHLGIRRGEILEVIEFTSNEEMLCRDPKGKYGYVPRTALLPLETEVYDDVDFCDPLENQPLPLGR

SEQ ID NO: 14506 - protein, 670 aa, Homo sapiens
MAHHLPAAMESHQDFRSIKAKFQASQPEPSDLPKKPPKPEFGKLKKFSQPELSEHPKKAPLPEFGAVSLKPPPPEVTDLPKKPPPPEVTDLPKKPPPPEVTDLPKKPPPPEVTDLPKKPSKLELSDLSKKFPQLGATPFPRKPLQPEVGEAPLKASLPEPGAPARKPLQPDELSHPARPPSEPKSGAFPRKLWQPEAGEATPRSPQPELSTFPKKPAQPEFNVYPKKPPQPQVGGLPKKSVPQPEFSEAAQTPLWKPQSSEPKRDSSAFPKKASQPPLSDFPKKPPQPELGDLTRTSSEPEVSVLPKRPRPAEFKALSKKPPQPELGGLPRTSSEPEFNSLPRKLLQPERRGPPRKFSQPEPSAVLKRHPQPEFFGDLPRKPPLPSSASESSLPAAVAGFSSRHPLSPGFGAAGTPRWRSGGLVHSGGARPGLRPSHPPRRRPLPPASSLGHPPAKPPLPPGPVDMQSFRRPSAASIDLRRTRSAAGLHFQDRQPEDIPQVPDEIYELYDDVEPRDDSSPSPKGRDEAPSVQQAARRPPQDPALRKEKDPQPQQLPPMDPKLLKQLRKAEKAEREFRKKFKFEGEIVVHTKMMIDPNAKTRRGGGKHLGIRRGEILEVIEFTSNEEMLCRDPKGKYGYVPRTALLPLETEVYDDVDFCDPLENQPLPLGR

SEQ ID NO: 14507 - protein, 23 aa, Homo sapiens
KFSQPEVAEGMSRQNLGLKLRGR

SEQ ID NO: 14508 - protein, 439 aa, Homo sapiens
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSREEARAQEAAEFEEMAAWALAAGRKVKKEPGLAAEVGSALKAETPNNWNATEDQHEPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKVSLGPVSYVLVDSEDGRKKPVMPKKGPGSRREASDQKAPRGQQPAEATASTSRGPKAKPEGSPRRATNESRKV

SEQ ID NO: 14509 - protein, 204 aa, Homo sapiens
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSRREEGEERTGACSRGGFCLKGRDPQQLECHGRPA

SEQ ID NO: 14510 - protein, 378 aa, Homo sapiens
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSREEARAQEAAEFEEMAAWALAAGRKVKKEPGLAAEVGSALKAETPNNWNATEDQHEPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKNPERFDLGDHPY

SEQ ID NO: 14511 - protein, 279 aa, Homo sapiens
MAMSLLQDWCRSLDVDAHRALLVTGIPEGLEQADVEAVLQPTLLPLGTFRLRHMKALMNEKAQAALVEFVEDVNHAAIPREIPGKDGVWRVLWKDRAQDTRVLRQMRRLLLDDGPTQAAEAGTPGEAPTPPASETQAQDSGEVTGQAGSLLGAARNPRRGRRGRRNRTRRNRLTQKGKKRSRGGRPSAPARSEAEDSSDESLGIVIEEIDQGDLSGEEDQSALYATLQAAARELVRQWAPCNSEGGPCPTCPWEGIGGFGCDLTVQTRLSQSYVRDTQM

SEQ ID NO: 14512 - protein, 406 aa, Homo sapiens
MAWCVATADPAHTSRPLFTGLAVSRGSAGHAWSAGFDWAAVVVVTGRRCRSGQTVPGAARSPLLPHPLPSPLRVPPPTGALGRPLPRWPQPRRTPFWSVISKATKLRSPPWTSAPTASNLERDRRISRIDPIRSPTMAGGLFAVSKKYFQYLGTYDTGMEVWGGENLELSFRVWQCGGKLEIHPCSHVGHVFPKRAPYARPNFLQNTARAAEVWMDEYKEHFYNRNPPARKEAYGDISERKLLRERLRCKSFDWYLKNVFPNLHVPEDRPGWHGAIRSRGISSECLDYNSPDNNPTGANLSLFGCHGQGGNQFFEYTSNKEIRFNSVTELCAEVPEQKNYVGMQNCPKDGFPVPANIIWHFKEDGTIFHPHSGLCLSAYRTPEGRPDVQMRTCDALDKNQIWSFEK

SEQ ID NO: 14513 - protein, 575 aa, Homo sapiens
MASATEDPVLERYFKGHKAAITSLDLSPNGKQLGAGRARELGSRRLSDLQKNTEDLSRPLYKKPPADSRALGEWGKASKLQLNEDELKQQEELIERYAINIYLSDRISLHRHIEDKRMYECKSQKFNYRTLPTTSVIIAFYNEAWSTLLRTIHSVLETSPAVLLKEIILVDDLSDRVYLKTQLETYISNLDRVRLIRTNKREGLVRARLIGATFATGDVLTFLDCHCECNSGWLEPLLERIGRDETAVVCPVIDTIDWNTFEFYMQIGEPMIGGFDWRLTFQWHSVPKQERDRRISRIDPIRSPTMAGGLFAVSKKYFQYLGTYDTGMEVWGGENLELSFRVWQCGGKLEIHPCSHVGHVFPKRAPYARPNFLQNTARAAEVWMDEYKEHFYNRNPPARKEAYGDISERKLLRERLRCKSFDWYLKNVFPNLHVPEDRPGWHGAIRSRGISSECLDYNSPDNNPTGANLSLFGCHGQGGNQFFEYTSNKEIRFNSVTELCAEVPEQKNYVGMQNCPKDGFPVPANIIWHFKEDGTIFHPHSGLCLSAYRTPEGRPDVQMRTCDALDKNQIWSFEK

SEQ ID NO: 14514 - protein, 491 aa, Homo sapiens
MENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVLWEIESELPGGGEPPKDCDTESMAESN

SEQ ID NO: 14515 - protein, 336 aa, Homo sapiens
MYTVLTGTPPFMASPLSEMYQNIREGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRREGTLPTPVPPAGPGLCLLRFLASEHALLLLFSNGMVQVSFSGVPAQLVLSGEGEGLQLTLWEQGSPGTSYSLDVPRSHGCAPTTGQHLHHALRMLQSI

SEQ ID NO: 14516 - protein, 630 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 14517 - protein, 338 aa, Homo sapiens
MWEANPEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNLYDSCVDDTWNPKIFVVFDANQIYPEYLIDFH

SEQ ID NO: 14518 - protein, 232 aa, Homo sapiens
MFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKDNMWKL

SEQ ID NO: 14519 - protein, 257 aa, Homo sapiens
MWEVAHVSEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNLYDSCVDDTWNPKIFVVFDANQIYPEYLIDFH

SEQ ID NO: 14520 - protein, 257 aa, Homo sapiens; identical to SEQ ID NO: 14519

SEQ ID NO: 14521 - protein, 46 aa, Homo sapiens
MKWMTWTRQIPSGAGFTWQNVGSGTCFSRIPTVSVQLAVKISKKAS

SEQ ID NO: 14522 - protein, 518 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRLKFMHTSHQFLLLSSPPAKEARFRTAKKLYGSTFAFHGSHIENWHSILRNGLVNASYTKLQEWEKDSTGCPPRMSWSRDTTG

SEQ ID NO: 14523 - protein, 630 aa, Homo sapiens; identical to SEQ ID NO: 14516

SEQ ID NO: 14524 - protein, 388 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTVAFMVELDPRTTPHSDGPD

SEQ ID NO: 14525 - protein, 285 aa, Homo sapiens
MFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRWVPH

SEQ ID NO: 14526 - protein, 554 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQRRSFQI

SEQ ID NO: 14527 - protein, 249 aa, Homo sapiens
MFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGCRNCIK

SEQ ID NO: 14528 - protein, 854 aa, Homo sapiens
MGMCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 14529 - protein, 493 aa, Homo sapiens
MQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKRTAIPIPAKP

SEQ ID NO: 14530 - protein, 57 aa, Homo sapiens
MGMCSRQERIQKDIDVVIQKSRAEKDCLFADFRYSDSTFTFTYVGGPRRNSELAPGM

SEQ ID NO: 14531 - protein, 812 aa, Homo sapiens
MGMCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 14532 - protein, 833 aa, Homo sapiens
MEPAALRCAYFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 14533 - protein, 854 aa, Homo sapiens; identical to SEQ ID NO: 14528

SEQ ID NO: 14534 - protein, 812 aa, Homo sapiens; identical to SEQ ID NO: 14531

SEQ ID NO: 14535 - protein, 494 aa, Homo sapiens [sequence omitted]

SEQ ID NO: 14536 - protein, 200 aa, Homo sapiens
MASLYVGDLHPEVTEAMLYEKFSPAGPILSIRICRDKITRRSLGYAYVNYQQPVDAKRALETLNFDVIKGRPVRIMWSQRDPSLRKSGVGNVFIKNLGKTIDNKALYNIFSAFGNILSCKVACDEKGPKGYGFVHFQKQESAERAIDVMNGMFLNYRKIFVGRFKSHKEREAERGAWARQSTSADVKDFEEDTDEEATLR

SEQ ID NO: 14537 - protein, 200 aa, Homo sapiens; identical to SEQ ID NO: 14536

SEQ ID NO: 14538 - protein, 370 aa, Homo sapiens
MNVAAKYRMASLYVGDLHADVTEDLLFRKFSTVGPVLSIRICRDQVTRRSLGYAYVNFLQLADAQKALDTMNFDIIKGKSIRLMWSQRDAYLRRSGIGNVFIKNLDKSIDNKTLYEHFSAFGKILSSKVMSDDQGSKGYAFVHFQNQSAADRAIEEMNGKLLKGCKVFVGRFKNRKDREAELRSKASEFTNVYIKNFGGDMDDERLKDVFSKYGKTLSVKVMTDSSGKSKGFGFVSFDSHEAAKKAVEEMNGRDINGQLIFVGRAQKKVERQAELKQMFEQLKRERIRGCQGVKLYIKNLDDTIDDEKLRNEFSSFGSISRVKVMQEEGQSKGFGLICFSSPEDATKAMTEMNGRILGSKPLSIALAQRH

SEQ ID NO: 14539 - protein, 428 aa, Homo sapiens
MRVLPELGESCLNSIAWPLCGDPEASTLEPGQSCDLVSPHRDCSKNSRGQTHSGKDKEMNVAAKYRMASLYVGDLHADVTEDLLFRKFSTVGPVLSIRICRDQVTRRSLGYAYVNFLQLADAQKALDTMNFDIIKGKSIRLMWSQRDAYLRRSGIGNVFIKNLDKSIDNKTLYEHFSAFGKILSSKVMSDDQGSKGYAFVHFQNQSAADRAIEEMNGKLLKGCKVFVGRFKNRKDREAELRSKASEFTNVYIKNFGGDMDDERLKDVFSKYGKTLSVKVMTDSSGKSKGFGFVSFDSHEAAKKAVEEMNGRDINGQLIFVGRAQKKVERQAELKQMFEQLKRERIRGCQGVKLYIKNLDDTIDDEKLRNEFSSFGSISRVKVMQEEGQSKGFGLICFSSPEDATKAMTEMNGRILGSKPLSIALAQRH

SEQ ID NO: 14540 - protein, 614 aa, Homo sapiens
MNASGSGYPLASLYVGDLHPDVTEAMLYEKFSPAGPILSIRVCRDVATRRSLGYAYINFQQPADAERALDTMNFEMLKGQPIRIMWSQRDPGLRKSGVGNIFIKNLEDSIDNKALYDTFSTFGNILSCKVACDEHGSRGFGFVHFETHEAAQQAINTMNGMLLNDRKVFVGHFKSRREREAELGARALEFTNIYVKNLPVDVDEQGLQDLFSQFGKMLSVKVMRDNSGHSRCFGFVNFEKHEEAQKAVVHMNGKEVSGRLLYAGRAQKRVERQNELKRRFEQMKQDRLRRYQGVNLYVKNLDDSIDDDKLRKEFSPYGVITSAKVMTEGGHSKGFGFVCFSSPEEATKAVTEMNGRIVGTKPLYVALAQRKEERKAILTNQYMQRLSTMRTLSNPLLGSFQQPSSYFLPAMPQPPAQAAYYGCGPVTPTQPAPRWTSQPPRPSCASMVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKIDEAVAVLQAHQAMEQPKAYMH

SEQ ID NO: 14541 - protein, 330 aa, Homo sapiens
MNASGSGYPLASLYVGDLHPDVTEAMLYEKFSPAGPILSIRVCRDVATRRSLGYAYINFQQPADAERALDTMNFEMLKGQPIRIMWSQRDPGLRKSGVGNIFIKNLEDSIDNKALYDTFSTFGNILSCKVACDEHGSRGFGFVHFETHEAAQQAINTMNGMLLNDRKVFVGHFKSRREREAELGARALEFTNIYVKNLPVDVDEQGLQDLFSQFGKMLSVKVMRDNSGHSRCFGFVNFEKHEEAQKAVVHMNGKEVSGRLLYAGRAQKRVERQNELKRRFEQMKQDRLRRYQGVNLYVKNLDDSIDDDKLRKEFSPYGVITSAKKRRQRP

SEQ ID NO: 14542 - protein, 171 aa, Homo sapiens
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKKRKSSLPWLPKGQCFWLSALRPCKL

SEQ ID NO: 14543 - protein, 614 aa, Homo sapiens; identical to SEQ ID NO: 14540

SEQ ID NO: 14544 - protein, 149 aa, Homo sapiens
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKISA

SEQ ID NO: 14545 - protein, 193 aa, Homo sapiens
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGTCYLVLKRWSDWMVLSFLPLLLSCDFEGSVSTPLSMMSTPSWLARSRACCWRLTTQSCCSCWSLQNPSMPRKGNPRFHGCQKDSVSGSQP

SEQ ID NO: 14546 - protein, 134 aa, Homo sapiens
CKCSSAAHSTYRVQEPAVHIPGQEPLTASMLAAAPLHEQKQMIGTCYLVLKRWSDWMVLSFLPLLLSCDFEGSVSTPLSMMSTPSWLARSRACCWRLTTQSCCSCWSLQNPSMPRKGNPRFHGCQKDSVSGSQP

SEQ ID NO: 14547 - protein, 168 aa, Homo sapiens
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKIDEAVAVLQAHQAMEQPKAYMH

SEQ ID NO: 14548 - protein, 152 aa, Homo sapiens
  MOD_RES (1)..(1): Any amino acid
XQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKAQRRKVQRLVKYILALKELSTQNL

SEQ ID NO: 14549 - protein, 170 aa, Homo sapiens
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKAQRRKVQRLVKYILALKELSTQNL

SEQ ID NO: 14550 - protein, 330 aa, Homo sapiens; identical to SEQ ID NO: 14541

SEQ ID NO: 14551 - protein, 200 aa, Homo sapiens; identical to SEQ ID NO: 14536

SEQ ID NO: 14552 - protein, 200 aa, Homo sapiens; identical to SEQ ID NO: 14536

SEQ ID NO: 14553 - protein, 200 aa, Homo sapiens; identical to SEQ ID NO: 14536

SEQ ID NO: 14554 - protein, 200 aa, Homo sapiens; identical to SEQ ID NO: 14536

SEQ ID NO: 14555 - protein, 377 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTAPQLPLACWAHPMPSPSPTSSAQAHALLGFTTCFPRAAAGL

SEQ ID NO: 14556 - protein, 243 aa, Homo sapiens
MIAFKLDEDLCAAPANGGNVSRPPVTLRLVIPASQCGSLIGKAGTKIKEIREVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 14557 - protein, 424 aa, Homo sapiens
MPRCPALILYLQSSARITISEGSCPERITTITGSTAAVFHAVSMIAFKLDEDLCAAPANGGNVSRPPVTLRLVIPASQCGSLIGKAGTKIKEIREVRGEIYHPQGIRGKGAVVRGVLGLWRPPHLESSEPGQPFSGLWEQPEVAPVLCLQTTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 14558 - protein, 360 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 14559 - protein, 46 aa, Homo sapiens
MSGSDGGLEEEPELSITLTLRMLMHGKEVGSIIGKKGETVKRIREQ

SEQ ID NO: 14560 - protein, 124 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKI

SEQ ID NO: 14561 - protein, 168 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICA

SEQ ID NO: 14562 - protein, 75 aa, Homo sapiens
MSGSDGGLEEEPELSITLTLRMLMHGKEVGSIIGKKGETVKRIREQSSARITISEGSCPERITTITGSTAAVFHA

SEQ ID NO: 14563 - protein, 360 aa, Homo sapiens; identical to SEQ ID NO: 14558

SEQ ID NO: 14564 - protein, 92 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPA

SEQ ID NO: 14565 - protein, 86 aa, Homo sapiens
MSGSDGGLEEEPELSITLTLRMLMHGKEVGSIIGKKGETVKRIREQSSARITISEGSCPERITTITGSTAAVFHAVSMIAFKLDEV

SEQ ID NO: 14566 - protein, 107 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLV

SEQ ID NO: 14567 - protein, 1007 aa, Homo sapiens
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVKYIAKLSGEKDHLHSVMVHLQQENKKLKKEIEEKKMKAENTRLCTKALGPSRTESTQREKVCGTLGWKGLPQDMGQRMDLTKYIGMPHCPGSSYC

SEQ ID NO: 14568 - protein, 882 aa, Homo sapiens
MGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVKYIAKLSGEKDREPTRASSPNTTRPSSPSHSHLHSVMVHLQQENKKLKKEIEEKKMKAENTRLCTKALGPSRTESTQREKVCGTLGWKGLPQDMGQRMDLTKYIGMPHCPGSSYC

SEQ ID NO: 14569 - protein, 157 aa, Homo sapiens
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEKL

SEQ ID NO: 14570 - protein, 68 aa, Homo sapiens
MKDEAGERDREVSSLNSKLLSLQLDIKNLHDVCKRQRKTLQDNQLCMEEAMNSSHDKKQAQALAFEES

SEQ ID NO: 14571 - protein, 1022 aa, Homo sapiens
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAGEAPAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVKYIAKLSGEKDHLHSVMVHLQQENKKLKKEIEEKKMKAENTRLCTKALGPSRTESTQREKVCGTLGWKGLPQDMGQRMDLTKYIGMPHCPGTSAICQKNKCDFFL

SEQ ID NO: 14572 - protein, 110 aa, Homo sapiens
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYS

SEQ ID NO: 14573 - protein, 47 aa, Homo sapiens
MKDEAGERDREVSSLNSKLLSLQLDIKNLHDVCKRQRKTLQDNQLCM

SEQ ID NO: 14574 - protein, 511 aa, Homo sapiens [sequence omitted]

SEQ ID NO: 14575 - protein, 486 aa, Homo sapiens
MESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGFLREHLDTFFDPPLPAEKAEAIRKIGFGTNNKIFLEFEEPFWEPDCQLIQLVWEDTSPLEDAAPELQDAWFRKLIGFVVLPAFASVHVLCGFIAGLESEFMETLSDEEVLLCLTQVLRRVTAPDPVCGGSHTSHVLLHDARGSAVGMEGGRPPPQSVGPAGAAAQAQALAGPSLLCSTRVGGRLGPSFLLTDFSLA

SEQ ID NO: 14576 - protein, 113 aa, Homo sapiens
MATLFYGLIDQTREFLHAAETPVPSVGEYLKKEIGQHVAGWTEDEETRKLKLAVLNSFFNLECCVSGTHRRTGLCCRDGGRPTASSVCGPRRCSSPGPGSSWAQPTLFHPCRG

SEQ ID NO: 14577 - protein, 232 aa, Homo sapiens
MESTGSVGEAPGGPRVLVVGGGIAGLGAAQRLCGHSAFPHLRVLEATARAGGRIRSERCFGGVVEVGAHWIHAAPELQDAWFRKLIGFVVLPAFASVHVLCGFIAGLESEFMETLSDEEVLLCLTQVLRRVTGNPRLPAPKSVLRSRWHSAPYTRGSYSYVAVGSTGGDLDLLAQPLPADGAGAQLQILFAGEATHRTFYSTTHGALLSGWREADRLLSLWAPQVQQPRPRL

SEQ ID NO: 14578 - protein, 69 aa, Homo sapiens
MESTGSVGEAPGGPRVLVVGGGIAGLGAAQRLCGHSAFPHLRVLEATARAGGRIRSERCFGAIKDSQTA

SEQ ID NO: 14579 - protein, 463 aa, Homo sapiens
MESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGFLREHLDTSPLEDAAPELQDAWFRKLIGFVVLPAFASVHVLCGFIAGLESEFMETLSDEEVLLCLTQVLRRVTGNPRLPAPKSVLRSRWHSAPYTRGSYSYVAVGSTGGDLDLLAQPLPADGAGAQLQILFAGEATHRTFYSTTHGALLSGWREADRLLSLWAPQVQQPRPRL

SEQ ID NO: 14580 - protein, 83 aa, Homo sapiens
MESTGSVGEAPGGPRVLVVGGGISRSCLRGKPHIARFTPRRTGLCCRDGGRPTASSVCGPRRCSSPGPGSSWAQPTLFHPCRG

SEQ ID NO: 14581 - protein, 325 aa, Homo sapiens
MESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGLSTFSVGSLPDLSLSSWRLCRMKKYFCVSPKCSGE

SEQ ID NO: 14582 - protein, 43 aa, Homo sapiens
MESTGSVGEAPGGRHGPRRGPHPLGALLRWRGGGGRALDPCCP

SEQ ID NO: 14583 - protein, 991 aa, Homo sapiens
MSAVGLVLLVLALRLRATTVKPEEGSFCSNSQVAFRDACYEFVPLGRTFRDAQSWCEGQGGHLVFIQDEGTQWFLQKHISQDREWWIGLTWNLARNGTTEGPGTWLDTSNVTYSNWHGGQAAAAPDTCGHIGRGPSSEWVTSDCAQTFAFMCEFRVGQSLACEGLNATVHCGLGQVIQVQDAVYGRQNPHFCTQDAGRPSDLEQGCSWANVKEEVAGQCQELQSCQVAADETYFGNLCPTQGSYLWVQYQCREALQLMVSSESFIFDNVTISLTWLLSPYIGNLSCIISTGDSHTFDPYNPPSVSSNVTHQFTSPGEFTVFAECTTSEWHVTAQRQVTVRDKMETLSVTACSGLSQSGAGPLCQAVFGDPLWIQVELDGGTGVTYTVLLGDITLAESTTQKGSLPYNLILDRETQKLMGPGRHRLEIQATGNTTTSTISRNITVHLVELLSGLQASWASDHLELGQDLLITISLAQGTPEELTFEVAGLNATFSHEQVSFGEPFGICRLAVPVEGTFLVTMLVRNAFSNLSLEIGNITITAPSGLQEPSGMNAEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQGSCMGDSWEGAPPAAHVSHAR

SEQ ID NO: 14584 - protein, 519 aa, Homo sapiens
  MOD_RES (1)..(1): Any amino acid
XLAQGTPEELTFEVAGLNATFSHEQVSFGEPFGICRLAVPVEGTFLVTMLVRNAFSNLSLEIGNITITAPSGLQEPSGMNAEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQGSCMGDSWEGAPPAAHVSHAR

SEQ ID NO: 14585 - protein, 265 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSDAPRGTWSTGLPKRNEAKTGADTTAAGPLFQQRPYPSPGAVLRANAEASRTKQQD

SEQ ID NO: 14586 - protein, 265 aa, Homo sapiens; identical to SEQ ID NO: 14585

SEQ ID NO: 14587 - protein, 265 aa, Homo sapiens; identical to SEQ ID NO: 14585

SEQ ID NO: 14588 - protein, 170 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNAAVSRKDEELDPMDPSSYSDAPRGTWSTGLPKRNEAKTGADTTAAGPLFQQRPYPSPGAVLRANAEASRTKQQD

SEQ ID NO: 14589 - protein, 481 aa, Homo sapiens
MYQASAVSLLPRDIPSCHSPSPGFSHLPTSSSQLAPDLLQFPLGQDPSFLAIPILTLPPSDSLVPPYIVWYIVWPSALISFLGCTLTVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 14590 - protein, 419 aa, Homo sapiens
MAAEVLPSARWQYCGAPDGSQRAVLVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 14591 - protein, 186 aa, Homo sapiens
MAAEVLPSARWQYCGAPDGSQRAVLVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMTPSTFLPAMMMQPSLKTCINLKIFFPLWRAETARPDAYGFWIPSSNFELIG

SEQ ID NO: 14592 - protein, 349 aa, Homo sapiens
MMLNCSTCSHYFQVFHQESKIIFWKEPRTCFLILSLPLPGELTWDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 14593 - protein, 195 aa, Homo sapiens
MASRGGGRGRGRGQLTFNVEAVGIGKGDALPPPTLQPSPLFPPLEFRPVPLPSGEEGEYVLALKQELRGAMRQLPYFIRPAVPKRDWRRLPRELKIRVRKLQKERITILLPKRPPKTTEDKEETIQKLETLEKKEEEVTSEEDEEKEEEEEKEEEEEEEYDEEEHEEETDYIMSYFDNGEDFGGDSDDNMDEAIY

SEQ ID NO: 14594 - protein, 218 aa, Homo sapiens
MASRGGGRGRGRGQLTFNVEAVGIGKGDALPPPTLQPSPLFPPLEFRPVPLPSGEEGEYVLALKQELRGAMRQLPYFIRPAVPKRDVERYSDKYQMSGPIDNAIDWNPDWRRLPRELKIRVRKLQKERITILLPKRPPKTTEDKEETIQKLETLEKKEEEVTSEEDEEKEEEEEKEEEEEEEYDEEEHEEETDYIMSYFDNGEDFGGDSDDNMDEAIY

SEQ ID NO: 14595 - protein, 559 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 14596 - protein, 499 aa, Homo sapiens
MENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 14597 - protein, 542 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 14598 - protein, 296 aa, Homo sapiens
MGAAAPAESADLGNFWKAGEPLLQGPDALAAPMSRSPSTPQTTPSPQGRQSPWPLRSLTQSHIQYFQWGRPVPSTHLIEVRPTQDPAKPQRVVSEGWRRPALPGETALGRDLSCAWEGCMKGGLCRAWNPGRTWSPVTIGIAPPERQESPWRSPGQRARPAGRPAAQELLDPCTRETLLGALSQCPKGSARFDGPLWFEVSDSKGGRRNLQPRPSAFKPLSKNGAVASFVPRPGPLKPSLGPWSLSFCDDAWPSVLVQPAPSAIWDFWEATTPSCGSCSRVSFALEVTQSAGPFGS

SEQ ID NO: 14599 - protein, 971 aa, Homo sapiens
MGSFLSKLELSPSSPAQVRTDLPERPTKRRPPQPLHQVHRVQFVHRAHPAPRYRPVRRRPNLDPANPTTWLANEAWRRFPMKKSQNSPLGPLPSDWWESYLKRTIWSLRHPRPIWSPVTIRITPPDQRVPPSTSPEDVIALAGLPPSEELADPCSKETVLRALRECRKGKGRLEEPLFPESLDSKRRSPETRPSAFKPLMKNGTLTSFVPRPGPLKRSLHSWGSDHSLTKRPNCSSMSSLASIYRGGTLSSKRNAIGSSYSSCRNFSDPWKRSVPSVSFETPEWPIKKEKSCHRPSSPVPLVSDFESLGGSESSGQQNQKIPQLPSSPENLVSEIPPPQLGYAVSDENLTLGKKAELQSTGEATSVAHSPLKTPSLPTPPGCSQSELLPGTSPDSKPTATFILLTPTSPTLPVTDTTWPPSTSQADRSPMPPDPPAPPTIQSTLLGMVSSPTSHLSASAPPDATSAHLMLKPILGPLHNSEIGSSSYSRISVTAAASSISSLSTIQGTLTPTFKPIFGSIDPLKTTPMIAPFSSKQTPPPFTHASTHHFHGLVKATSVVMSTTLASTSKDSVFKPPLDFGVVNVTSAVGNTYSVPSTCDTFLLGTAQAFRADFTPATGFIFPPHHHPTIPTVHTVTMFTQVLSSVVQISPRSSTANFRGMGSPLPASALVSTNWLASTPSISNLTPAITSPLGSSSRPPFPLSQGANPQPAFGATNGQKQGPSQPALMPSVSSSFLFGSSAVALPTPMPTPAQPAFISTTQSALGCLTPSASTSQTPASTWSGIGGIPAGFPISQASTTGFRIVIQTHQSGAFGSVFGSRAPQPFTFGGFVTPMDCDESGIIMTGPDMSPTSGAFSIGALPSGTTNTMIPFGKGWSQNTEGLPSHRTAFSLGRGSISARKTMAPIAQNTPVPGQAKAGSSVGFGMPFPPAQGSVGRGPFRSSASSFSIGAKSKTPKNREKGHSRRHHAYKK

SEQ ID NO: 14600 - protein, 1035 aa, Homo sapiens
MGSFLSKLELSPSSPAQVRTDLPERPTKRRPPQPLHQVHRVQFVHRAHPAPRYRPVRRRPNLDPANPTTWLANEAWRRFPMKKSQNSPLGPLPSDWWESYLKRTIWSLRHPRPIWSPVTIRITPPDQRVPPSTSPEDVIALAGLPPSEELADPCSKETVLRALRECRKGKGRLEEPLFPESLDSKRRSPETRPSAFKPLMKNGTLTSFVPRPGPLKRSLHSWGSDHSLTKRPNCSSMSSLASIYRGGTLSSKRNAIGSSYSSCRNFSDPWKRSVPSVSFETPEWPIKKEKSCHRPSSPVPLVSDFESLGGSESSGQQNQKIPQLPSSPENLVSEIPPPQLGYAVSDENLTLGKKAELQVSNNAGEDTTEVNTDPFPETWLAIQPSLSLALPSSETDLTQGANPQLENLRKMQKSLGPLASPQSTGEATSVAHSPLKTPSLPTPPGCSQSELLPGTSPDSKPTATFILLTPTSPTLPVTDTTWPPSTSQADRSPMPPDPPAPPTIQSTLLGMVSSPTSHLSASAPPDATSAHLMLKPILGPLHNSEIGSSSYSRISVTAAASSISSLSTIQGTLTPTFKPIFGSIDPLKTTPMIAPFSSKQTPPPFTHASTHHFHGLVKATSVVMSTTLASTSKDSVFKPPLDFGVVNVTSAVGNTYSVPSTCDTFLLGTAQAFRADFTPATGFIFPPHHHPTIPTVHTVTMFTQVLSSVVQISPRSSTANFRGMGSPLPASALVSTNWLASTPSISNLTPAITSPLGSSSRPPFPLSQGANPQPAFGATNGQKQGPSQPALMPSVSSSFLFGSSAVALPTPMPTPAQPAFISTTQSALGCLTPSASTSQTPASTWSGIGGIPAGFPISQASTTGFRIVIQTHQSGAFGSVFGSRAPQPFTFGGFVTPMDCDESGIIMTGPDMSPTSGAFSIGALPSGTTNTMIPFGKGWSQNTEGLPSHRTAFSLGRGSISARKTMAPIAQNTPVPGQAKAGSSVGFGMPFPPAQGSVGRGPFRSSASSFSIGAKSKTPKNREKGHSRRHHAYKK

SEQ ID NO: 14601 - protein, 457 aa, Homo sapiens
MDSLWGPGAGSHPFGVHNSRLSPDLCPGKIVLRALKESGAGMPEQDKDPRVQENPGDQRRVPEVTGDAPSAFRPLRDNGGLSPFVPGPGPLQTDLHAQRSEIRYDQSSQTSWTSSCTNRNAISSSYSSTGGLPGLKRRRGPASSHCQLTLSSSKTVSEDRPQAVSSGHTQCEKVAEKAPGQTLALRNDSSRSEASRPSTRKFPLLPHRRGEPLMLPPPVELGYRVTAEDLDWEKEAAFQCIKSALQVEDKAISDCRPSRPSHTLSSLATGASGLPAVSKAPSMDAQQERHKSQDCLGLVAPLASATEVPSTAPMSGEKHRPPGPLFSSSDPLPATSSHSQDSAQVTSLIPAPFPAASMDAGMRRTRPGTSAPAAAAAAPPPSTLNRTLGSLLEWMEALHISGPQPQLQQVPRGQNQRSQTSRTSSCPKRNAISSSCSSTGDLPGRKRKRRQPHPTAS

SEQ ID NO: 14602 - protein, 462 aa, Homo sapiens
MDSLWGPGAGSHPFGVHNTRLSPDLCPGKIVLRALKESGAGMPEQDKDPRVQENPGDQRRVPEVTGDAPSAFRPLRDNGGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLALRNDSSTSEASRPSTHKFPLLPRRRGEPLMLPPPLELGYRVTVEDLDREKEAAFQRINSALQVEDKAISDCRPSRPSHTLSSLATGASGLPPVSKAPSMDAQQETHKSQDCLGLLAPLASAAGVPSTAPMSGKKHRPPGPLFSSSDPLPATSSHSQDSAQVTSLIPAPFPAASMDAGMRRTRCGTSAPAAAAAAPPPSTLNPTLGSLLEWMEALHISGPQPQLQQVPRGQNQRSQTSRTSSCPKRNAISSPYRSTGGLPERKRRRGPASSHCQLTLSS

SEQ ID NO: 14603 - protein, 462 aa, Homo sapiens; identical to SEQ ID NO: 14602

SEQ ID NO: 14604 - protein, 999 aa, Homo sapiens
MVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGNTFAHQQEHSPRKGPNNLSKRKLLPAVRAQGLPRRGQASSFPTRKE

SEQ ID NO: 14605 - protein, 461 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 14606 - protein, 455 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 14607 - protein, 381 aa, Homo sapiens
MSRHEGVSCDACLKGNFRGRRYKCLICYDYDLCASCYESGATTTRHTTDHPMQCILTRVDFDLYYGGEAFSVEQPQSFTCPYCGKMGYTETSLQEHVTSEHAETSTEVICPICAALPGGDPNHVTDDFAAHLTLEHRAPRDLDESSGVRHVRRMFHPGRGLGGPRARRSNMHFTSSSTGGLSSSQSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 14608 - protein, 234 aa, Homo sapiens
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQDVL

SEQ ID NO: 14609 - protein, 304 aa, Homo sapiens
MTLRTSVCCTRRRATISSSPWCASWSAGSRSRSSGAAAGPVTAWWCASRPTWASGSHSAARRPSSRRSSPRPETSCATPSTPAGTRTPRTSSASRSMATAGSTRYRSWSGCSRGVSAWLRPVGAVWTPPSSASMCFAGRSGGRSPPPLLFESSRNPWTRPCFSAHLGPPRDLETVLGSSACVYLAVGMRPRVRLEGPKLAQRAPGSQVSWQQNVGCWRHACRRTVDATQRYSGGISAASSPSPSASQPGAASSEAPGPVGAGLEEPSAATSEELFIPLHAGQTLAGLLASERWLIFQYLKWMQP

SEQ ID NO: 14610 - protein, 165 aa, Homo sapiens
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSSMEVFNANIFSTSCLFLKLLGSKLFY

SEQ ID NO: 14611 - protein, 37 aa, Homo sapiens
MSDPITLNVGGKLYTTSLATLTSFPDSMLGAMFSGKM

SEQ ID NO: 14612 - protein, 116 aa, Homo sapiens
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITL

SEQ ID NO: 14613 - protein, 71 aa, Homo sapiens
MSDPITLNVGGKLYTTSLATLTSFPDSMLGAMFSGKMPTKRDSQGNCFIDRDGKVFRYILNFLRTSHLDLP

SEQ ID NO: 14614 - protein, 1149 aa, Homo sapiens
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLILFANYIPEMVELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATAFYNYHVLELLQMLVTGGVSSQLEQHLDKDKVYGVADSCTSLLSGRNRCKLGLLSLHETILSDVNPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTETLYSPVYSYQPRTNSLSFPKQIAWNQSRTNSIISSQIPLGDNAKENERKTSDEVYDEDPFAYSEPL

SEQ ID NO: 14615 - protein, 433 aa, Homo sapiens
MTAASRANPYSIVSLEEDGLHLVTMSGANGFGNGKVHTRRRCRNRFVKKNGQCNIAFANMDEKSQRYLADMFTTCVDIRWRYMLLIFSLAFLASWLLFGVIFWVIAVAHGDLEPAEGHGRTPCVMQVHGFMAAFLFSIETQTTIGYGLRCVTEECLVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRGSEI

SEQ ID NO: 14616 - protein, 624 aa, Homo sapiens
MQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRGWFSMANAL

SEQ ID NO: 14617 - protein, 611 aa, Homo sapiens
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILDHLS

SEQ ID NO: 14618 - protein, 584 aa, Homo sapiens
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSSKSNVGAWGDYDHSAFMEPRYHVRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEQKMNSELSLSHKKEEDLLRENSVLQEEIAVLRLELDETKHQNQLRENKILEEIESVKEKTDKLLRAMQLNEEALTKTNI

SEQ ID NO: 14619 - protein, 1075 aa, Homo sapiens
MVVEVDSMPAASSVKKPFGLRSKMGKWCCRCFPCYRESGKSNVGTSGDHDDSAMKTLRSKMGKWCHHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQELKLTSEEESQRFKGSENSQPEKMSQELEINKDGDREVEEEMKKHESNNVGLLENLTNGVTAGNGDNGLIPQRKSRTPENQQFPDNESEEYHRICELLSDYKEKQMPKYSSENSNPEQDLKLTSEEESQRLKGSENGQPEKRSQEPEINKDGDRELENFMAIEEMKKHGSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDVLHENSTLREEIAMLRLELDTMKHQSQLREKKYLEDIESVKKKNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPILLTEAPLNPKANREKMTQIMFETFNTPAMYVAIQAVPSLYTSGRTTGIVMDSGDGVTHTVPIYEGNALPHATLRLDLAGRELPDYLMKILTERGYRFTTMAEREIVRDIKEKLCYVALDFEQEMATAASSSSLEKSYELPDGQVITIGNERFRCPEALFQPCFLGMESCGIHETTFNSIMKSDVDIRKDLYTNTVLSGGTTMYPGMAHRMQKEIAALAPSMMKIRIIAPPKRKYSVWVGGSILASLSTFQQMWISKQEYDESGPSIVHRKCF

SEQ ID NO: 14620 - protein, 394 aa, Homo sapiens
MVVEVDSMPAASSVKKPFGLRSKMGKWCCRCFPCYRESGKSNVGTSGDHDDSAMKTLRSKMGKWCHHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKVCSSQLYQHEAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPENVSRTRNK

SEQ ID NO: 14621 - protein, 508 aa, Homo sapiens
MVAEAGSMPAASSVKKPFGLRSKMGKWCRHCFPWCRGSGKSNVGTSGDHDDSAMKTLRSKMGKWCRHCFPWCRGSGKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTVLILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHSDEQNDTQKQLSEEQNTGILQDEILIHEEKQIEVAENEF

SEQ ID NO: 14622 - protein, 542 aa, Homo sapiens
MVTEVCSMPAASAVKKPFDLRSKMGKWFHHRFPCCKGSGKSNMGTSGDHDDSFMKMLRSKMGKCCHHCFPCCRGSGTSNVGTSGDHDNSFMKTLRSKMGKWCCHCFPCCRGSGKSNVGAWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADQNIPDEYGNTTLHYAVHNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEKKMNSELSLSHKKEEDLLRENSMLQEEIAMLISGDWN

SEQ ID NO: 14623 - protein, 381 aa, Homo sapiens
MVTEVCSMPAASAVKKPFDLRSKMGKWFHHRFPCCKGSGKSNMGTSGDHDDSFMKMLRSKMGKCCHHCFPCCRGSGTSNVGTSGDHDNSFMKTLRSKMGKWCCHCFPCCRGSGKSNVGAWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADQNIPDEYGNTTLHYAVHNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPGKEAEE

SEQ ID NO: 14624 - protein, 508 aa, Homo sapiens
MVAEAGSMPAASSVKKPFGLRSKMGKWCRHCFPWCRGSGKSNVGTSGDHDDSAMKTLRSKMGKWCRHCFPWCRGSSKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCREDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHNVICQLLSDYKEKQMLKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHSDEQNDTQKQLSEEQNTGILQDEILIHEEKQIEVAENEF

SEQ ID NO: 14625 - protein, 486 aa, Homo sapiens
MVAEAGSMPAASSVKKPFGLRSKMGKWCRHCFPWCRGSGKSNVGTSGDHDDSAMKTLRSKMGKWCRHCFPWCRGSGKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTVLILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHRDFSGHPNFPTTLPIKQ

SEQ ID NO: 14626 - protein, 593 aa, Homo sapiens
MVAEAGSMPAASSVKKPFGLRSKMGKWCRHCFPWCRGSGKSNVGTSGDHDDSAMKTLRSKMGKWCRHCFPWCRGSGKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKIESHSVSQAGVQWCDHSSLQPRPPEAQMVLQPQPQFFFLSFFLFLFLFLFFFSRDEVFAMFLRLVLNSWAQAIHPPQPPKVLGLQHGLTPLLLGVHEQKQQVVKFLIKKKANLNALDRYGRTVLILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHSDEQNDTQKQLSEEQNTGILQDEILIHEEKQIEVAENEF

SEQ ID NO: 14627 - protein, 359 aa, Homo sapiens
MAGHLASDFAFSPPPGGGGDGPWGAEPGWVDPLTWLSFQGPPGGPGIGPGVGPGSEVWGIPPCPPPYELCGGMAYCGPQVGVGLVPQGGLETSQPESEAGVGVESNSNGASPEPCTVPPGAVKLEKEKLEQNPEKSQDIKALQKELEQFAKLLKQKRITLGYTQADVGLILGVLFGKVFSQKTICRFEALQLSFKNMCKLRPLLQKWVEEADNNENLQEICKAETLMQARKRKRTSIENRVRGNLENLFLQCPKPTLQISHIAQQLGLEKDVVRVWFCNRRQKGKRSSSDYAQREDFEAAGSPFSGGPVSFPPAPGPHFGTPGYGSPHFTALYSSVPFPEGEVFPPVSVITLGSPMHSN

SEQ ID NO: 14628 - protein, 359 aa, Homo sapiens; identical to SEQ ID NO: 14627

SEQ ID NO: 14629 - protein, 328 aa, Homo sapiens
MAGHRPSNHFCPLPGSGGGGPRGPMPLRVDTLTWLSTQAAPGRVMVWPAVRPGICPGPDVWRIPLGPLPHEFRGWIAPCRPRLGASEAGDWLRRPSEGALPGPYIALRSIPKLPPPEDISGILKELQQLAKELRQKRLSLGYSQADVGIAVGALFGKVLSQTTICRFEAQQLSVANMWKLRPLLKKWLKEVEAENLLGLCKMEMILQQSGKWRRASRERRIGNSLEKFFQRCPKPTPQQISHIAGCLQLQKDVVRVWFYNRSKMGSRPTNDASPREIVGTAGPPCPGAPVCFHLGLGLPVDIPHYTRLYSAGVAHSSAPATTLGLLRF

SEQ ID NO: 14630 - protein, 794 aa, Homo sapiens
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 14631 - protein, 520 aa, Homo sapiens
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQVPSPALPTSWQLPTTNSVGSRGTSCGPYWWLSSWWPWPAMAWPCTASASGSSAHGTPPWSSLSSWQSATCSAP

SEQ ID NO: 14632 - protein, 125 aa, Homo sapiens
  MOD_RES (1)..(1): Any amino acid
XSLQCVKLGRATARWWWVVKVKPHDKDAKMKYQECNKIVKQKAFERAIAGDEHKRSVVDSLDIESMTIEGEYSGPKLEDDKVTITFMKGLMQWYKDQKKLHQKCAYQDFRQKSGIITSQDCVQTT

SEQ ID NO: 14633 - protein, 161 aa, Homo sapiens
MGANQLVVLNVYDMYWMNEYTSSIGIGVFHSGIEVYGRAVVLGSTDFLEDDIEKIVEELGKEYKGNAYHLMHKNCNHFSSALSEILCGKEIPRWINRLAYFSSCIPFLQSCLPKEWLTPAALQSSVSQELQDELEEAEDAAASASVASTAAGSRPGRHTKL

SEQ ID NO: 14634 - protein, 194 aa, Homo sapiens
MGANQLVVLNVYDMYWMNEYTSSIGIGVFHSGIEVYGREFAYGGHPYPFSGIFEISPGNASELGETFKFKEAVVLGSTDFLEDDIEKIVEELGKEYKGNAYHLMHKNCNHFSSALSEILCGKEIPRWINRLAYFSSCIPFLQSCLPKEWLTPAALQSSVSQELQDELEEAEDAAASASVASTAAGSRPGRHTKL

SEQ ID NO: 14635 - protein, 101 aa, Homo sapiens
MRLTFLKKIAQLNYLEILVVLLSYTLKTTFQYWMNEYTSSIGIGVFHSGIEVYGREFAYGGHPYPFSGIFEISPGNASELGETFKFKEAVVLGSTDFLEDD

SEQ ID NO: 14636 - protein, 1023 aa, Homo sapiens
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 14637 - protein, 1160 aa, Homo sapiens
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 14638 - protein, 1156 aa, Homo sapiens
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 14639 - protein, 1061 aa, Homo sapiens
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 14640 - protein, 1074 aa, Homo sapiens
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 14641 - protein, 511 aa, Homo sapiens
MLKMAEPIASLMIVECRACLRCSPLFLYQREKDRMTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAGKLVWMRLLSEGRVRSGLCGG

SEQ ID NO: 14642 - protein, 511 aa, Homo sapiens; identical to SEQ ID NO: 14641

SEQ ID NO: 14643 - protein, 477 aa, Homo sapiens
MTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAGKLVWMRLLSEGRVRSGLCGG

SEQ ID NO: 14644 - protein, 474 aa, Homo sapiens
MSIQAPPRLLELAGQSLLRDQALSISAMEELPRVLYLPLFMEAFSRRHFQTLTVMVQAWPFTCLPLGSLMKTLHLETLKALLEGLHMLLTQKDRPRRWKLQVLDLRDVDENFWARWPGAWALSCFPETTSKRQTAEDCPRMGEHQPLKVFIDICLKEIPQDECLRYLFQWVYQRRGLVHLCCSKLVNYLTPIKYLRKSLKIIYLNSIQELEIRNMSWPRLIRKLRCYLKEMKNLRKLVFSRCHHYTSDNELQGRLVAKFSSVFLRLEHLQLLKIKLITFFSGHLEQLIRCLQNPLENLELTYGYLLEEDMKCLSQYPSLGYLKHLNLSYVLLFRISLEPLGALLEKIAASLKTLILEGCQIHYSQLSAILPALSRCSQLTTFYFGRNCMSIDALKDLLRHTSGLSKLSLETYPAPEESLNSLVRVNWEIFTPLRAELMCTLREVRQPKRIFIGPTPCPSCGSSPSEELELHLCC

SEQ ID NO: 14645 - protein, 229 aa, Homo sapiens
MKGGKAHQTCPFHNRTSVLTGLVITNDPVSDSLFVKGCFELQERCLQNPLENLELTYGYLLEEDMKCLSQYPSLGYLKHLNLSYVLLFRISLEPLGALLEKIAASLKTLILEGCQIHYSQLSAILPALSRCSQLTTFYFGRNCMSIDALKDLLRHTSGLSKLSLETYPAPEESLNSLVRVNWEIFTPLRAELMCTLREVRQPKRIFIGPTPCPSCGSSPSEELELHLCC

SEQ ID NO: 14646 - protein, 474 aa, Homo sapiens
MSLQAPSRLLELAGQSLLRNQFLTIFTLDELPREVFPLMFMEAFSMRRFEALKLMVQAWPFLSLPLGSLMKTLHLETLQAVLRGLDTLVAQKVRPRRWKLQVLDLRDVDENFWTIWSGARVLSCSPEAMSKRQTVEDCPRMGEHQPLKVFIDLCLKESTLDECLSYLFGWIHYRRGLVHLCCSKVQNYSMPTSSFRNLLERIYPDSIQELEVWKKCSLNKTGKFAPYLSQMSNLRELFLAFGYERELYVSVQWPCIPDLDSPFLCLYYPQMLYIKKISNIKEHLEHLLRYLKNPLGAFIFSDAYLTDRDMECLSQYPSLSQLKELRLIHILMWTTHLEPLGVLLEKVAATLKTLVLKDCRIQDPQLRVLLPALSHCSQLTTFNFHGNETSMNALKDLLRHTGGLSKLGLELYPAPLESLDYKGHVNWEILTPIRAELMRTLREVRQPKRIFFGPVPCPNCGSWPSEKVDFHLCS

SEQ ID NO: 14647 - protein, 477 aa, Homo sapiens
MKMSIRIPPRLLELGRSLLRDQALAVSTLEELPTELFPPLFMEAFSRRRCEALKLMVQAWPFRRLPLRPLIKMPCLEAFQAVLDGLDALLTQGVRPRRWKLQVLDLQDVCENFWMVWSEAMAHGCFLNAKRNKTPVQDCPRMRERQPLTVFVELWLKNRTLDEYLTCLLLWVKQRRDLLHLCCKKLKILGMPFRNIRSILKMVNLDCIQEVEVNCKWILPILTQFTPYLGHLRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCLELYPAPQESYGADGTLCWSRFAQIRAELMKKVRHLRHPKRILFCTDNCPDHGDRSFYDLEADQYCC

SEQ ID NO: 14648 - protein, 435 aa, Homo sapiens
MEAFSRRRCEALKLMVQAWPFRRLPLRPLIKMPCLEAFQAVLDGLDALLTQGVRPRRWKLQVLDLQDVCENFWMVWSEAMAHGCFLNAKRNKTPVQDCPRMRERQPLTVFVELWLKNRTLDEYLTCLLLWVKQRRDLLHLCCKKLKILGMPFRNIRSILKMVNLDCIQEVEVNCKWILPILTQFTPYLGHLRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCLELYPAPQESYGADGTLCWSRFAQIRAELMKKVRHLRHPKRILFCTDNCPDHGDRSFYDLEADQYC

SEQ ID NO: 14649 - protein, 436 aa, Homo sapiens
MEAFSRRRCEALKLMVQAWPFRRLPLRPLIKMPCLEAFQAVLDGLDALLTQGVRPRRWKLQVLDLQDVCENFWMVWSEAMAHGCFLNAKRNKTPVQDCPRMRERQPLTVFVELWLKNRTLDEYLTCLLLWVKQRRDLLHLCCKKLKILGMPFRNIRSILKMVNLDCIQEVEVNCKWILPILTQFTPYLGHLRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCLELYPAPQESYGADGTLCWSRFAQIRAELMKKVRHLRHPKRILFCTDNCPDHGDRSFYDLEADQYCC

SEQ ID NO: 14650 - protein, 483 aa, Homo sapiens
MSLQAPPRLLELAEQSLLRDRALAIPTLEELPRELFPPLFMEAFTRRCCETLTTMVQAWPFTCLPLGSLMKSCNLEIFRAVLEGLDALLAQKVRPRRWKLQVLDLRNVDENFWGIWSGASALSPEALSKRRTAGNCPRPGGQQPLMVILDLCFKNGMLDECLTHFLEWGKQRKGLLHVCCKELQIFGIAIHRIIEVLNTVELDCIQEVEVCCPWELSILIRFAPYLGQMRNLRKLVLFNIHVSACIPLDRKEQFVIQFTSQFLKLDYFQKLYMHSVSFLEGHLDQLLRCLQAPLETVVMTECLLSESDLKHLSWCPSIRQLKELDLRGITLTHFSPEPLSVLLEQAEATLQTLDLEDCGIVDSQLSAILPALSRCSQLSTFSFCGNLISMAALENLLRHTVGLSKLSLELYPAPLESYDAQGALCWGRFSQLGAELMKTLRDLRQPKIIVFSTVPCPRCGIRASYDLEPSHCLLNACCQGGFI

SEQ ID NO: 14651 - protein, 474 aa, Homo sapiens
MSIQAPPRLLELAGQSLLRDQALSISAMEELPRVLYLPLFMEAFRRRHFQTLTVMVQAWPFTCLPLGSLMKTLHLETLKALLEGLHMLLTQKDRPRRWKLQVLDLRDVDENFWARWPGAWALSCFPETMSKRQTAEDCPRMGEHQPLKVFIDICLKEIPQDECLRYLFQWVYQRRGLVHLCCSKLVNYLTPIKHLRKSLKIIYLNSIQQLEIRNMSWPRLIRKLRCYLKEMKNLRKLVFSRCHHSMSDNELEGRLVTKFSSVFLRLEHLQLLKIKLITFFSGHLEQLIRCLQNPLENLELTYGYLLEEDMKCLSQYPSLGYLKHLNLSYVLLFRISLEPLGALLEKIAASLETLILEGCQIHYSQLSAILPGLSHCSQLTTFYFGRNCMSMGALKDLLRHTSGLSKLSLETYPAPEESLNSLVRVDWEIFALLRAELMCTLREVRQPKRIFIGPTPCPSCGSSPSEELELHLCC

SEQ ID NO: 14652 - protein, 474 aa, Homo sapiens
MSIQAPPRLLELAGQSLLRDQALSISAMEELPRVLYLPLFMEAFRRRHFQTLTVMVQAWPFTCLPLGSLMKTLHLETLKALLEGLHMLLTQKDRPRRWKLQVLDLRDVDENFWARWPGAWALSCFPETMSKRQTAEDCPRMGEHQPLKVFIDICLKEIPQDECLRYLFQWVYQRRGLVHLCCSKLVNYLTPIKHLRKSLKIIYLNSIQQLEIRNMSWPRLIRKLRCYLKEMKNLRKLVFSRCHHSMSDNELEGRLVTKFSSVFLRLEHLQLLKIKLITFFSGHLEQLIRCLQNPLENLELTYGYLLEEDMKCLSQYPSLGYLKHLNLSYVLLFRISLEPLGALLEKIAASLETLILEGCQIHYSQLSAILPGLSHCSQLTTFYFGRNCMSMGALKDLLCHTSGLSKLSLETYPAPEESLNSLVRVDWEIFALLRAELMCTLREVRQPKRIFIGPTPCPSCGSSPSEELELHLCC

SEQ ID NO: 14653 - protein, 426 aa, Homo sapiens
MSIQAPPRLLELAGQSLLRDQALSISAMEELPRVLYLPLFMEAFRRRHFQTLTVMVQAWPFTCLPLGSLMKTLHLETLKALLEGLHMLLTQKDRPRRWKLQVLDLRDVDENFWARWPGAWALSCFPETMSKRQTAEDCPRMGEHQPLKVFIDICLKEIPQDECLRYLFQWVYQRRGLVHLCCSKLVNYLTPIKHLRKSLKIIYLNSIQQLEIRNMSWPRLIRKLRCYLKEMKNLRKLVFSRCLQNPLENLELTYGYLLEEDMKCLSQYPSLGYLKHLNLSYVLLFRISLEPLGALLEKIAASLETLILEGCQIHYSQLSAILPGLSHCSQLTTFYFGRNCMSMGALKDLLCHTSGLSKLSLETYPAPEESLNSLVRVDWEIFALLRAELMCTLREVRQPKRIFIGPTPCPSCGSSPSEELELHLCC

SEQ ID NO: 14654 - protein, 478 aa, Homo sapiens
MKMSIRTPPRLLELAGRSLLRDQALAMSTLEELPTELFPPLFMEAFSRRRCEALKLMVQAWPFRRLPLRPLIKMPCLEAFQAVLDGLDALLTQGVRPRRWKLQVLDLQDVCENFWMVWSEAMAHGCFLNAKRNKKPVQDCPRMRGRQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCVELYPAPRESYGADGTLCWSRFAQIRAELMNRVRDLRHPKRILFCTDYCPDCGNRSFYDLEADQYCC

SEQ ID NO: 14655 - protein, 478 aa, Homo sapiens; identical to SEQ ID NO: 14654

SEQ ID NO: 14656 - protein, 474 aa, Homo sapiens
MSLQSPSRLLELAGQSLLRNQFLTIFILDELPREVFPLMFMEASSMRHFEALKLMVQAWPFLRLPLGSLMKTPHLETLQAVLKGLDTLLAQKLRPRRWKLQVLDLRDVDGNFWTIWSGARALSCSPEAMRKRQTVEDYPRTGEHQPLKVFIDLCQKESTLDECLSYLCRWIHYRRGLVHLCCNKVQNYSMPTSSFRNLLKRVYPDSIQELEIKRKCSLNKTGKFAPYLSQMSNLRKLFLAFGYDDELYVSGQQQFVPDLDCPFLCLYYPQMLYIRKISNIKEHLEHLLRCLKNPLGTFIFCHAYLADQDMECLSQYPSLSQLKELHLIHILMWTTNLEPLGALLEKVAATLEILTLKDCQIQDSQLRVLLPALSRCSQLTTFYFRGNETSTNALKDLLCHTGGLSKLGLELYPAPLECLDNRGHVNWEILAPIRAELMCTLREVRQPKRIFFGPIPCPSCGSWPSEKVDFHLCS

SEQ ID NO: 14657 - protein, 474 aa, Homo sapiens
MSLQSPSRLLELAGQSLLRNQFLTIFILDELPREVFPLMFMEASSMRHFEALKLMVQAWPFLRLPLGSLMKTPHLETLQAVLKGLDTLLAQKLRPRRWKLQVLDLRDVDGNFWTIWSGARALSCSPEAMSKRQTVEDYPRTGEHQPLKVFIDLCQKESTLDECLSYLCRWIHYRRGLVHLCCNKVQNYSMPTSSFRNLLKRVYPDSIQELEIKRKCSLNKTGKFAPYLSQMSNLRKLFLAFGYDDELYVSGQQQFVPDLDCPFLCLYYPQMLYIRKISNIKEHLEHLLRCLKNPLGTFIFCHAYLADQDMECLSQYPSLSQLKELHLIHILMWTTNLEPLGALLEKVAATLEILTLKDCQIQDSQLRVLLPALSRCSQLTTFYFRGNETSTNALKDLLCHTGGLSKLGLELYPAPLECLDNRGHVNWEILAPIRAELMCTLREVRQPKRIFFGPIPCPSCGSWPSEKVDFHLCS

SEQ ID NO: 14658 - protein, 479 aa, Homo sapiens
MSFQAPRRLLELAGQSLLRDQALAISVLDELPRELFPRLFVEAFTSRRCEVLKVMVQAWPFPCLPLGSLMKTPDLEILHYVVDGIDCLLAQKVRPRRWKLQVLEMRDVDENFWTIWSGARPLSCSPEAMSKRQTVEDCPRTGEKQPLKVFMDVCLKEKSVDEDLSFFSGWVQHRRRSVHLCCTKVVNYSMNILNFRNILETVYPDSIQVLEIWNMCWPCMVAEVSRYLSQMKNLRKLFISDGCGYLPSFESQGQLVAEFSSVFLRLEYLQMLYMRRIRFFEGYLDQLIRCLKSPLETLALTYGSLDEEDLKCLPWYPSLSQLKQLNLSHGTLRFIRLEPLRALLEKVAATLQTLFLVDCGIGDSKLRVILPALSRCSNLTTFCFHGNDTSMDGLKDLLRHTGRLSNLSLETYPAPRESLDNRGRVISELLTPLQAELMRILREVREPNRIFFGPVSCPCCGMSPTEQLEFNFCLRGRPA

SEQ ID NO: 14659 - protein, 410 aa, Homo sapiens
MKTPDLEILHYVVDGIDCLLAQKVRPRRWKLQVLEMRDVDENFWTIWSGARPLSCSPEAMSKRQTVEDCPRTGEKQPLKVFMDVCLKEKSVDEDLSFFSGWVQHRRRSVHLCCTKVVNYSMNILNFRNILETVYPDSIQVLEIWNMCWPCMVAEVSRYLSQMKNLRKLFISDGCGYLPSFESQGQLVAEFSSVFLRLEYLQMLYMRRIRFFEGYLDQLIRCLKSPLETLALTYGSLDEEDLKCLPWYPSLSQLKQLNLSHGTLRFIRLEPLRALLEKVAATLQTLFLVDCGIGYSKLRVILPALSRCSNLTTFCFHGNDTSMDGLKDLLRHTGRLSNLSLETYPAPRESLDNRGRVISELLTPLQAELMRILREVREPNRIFFGPVSCPCCGMSPTEQLEFNFCLRGRPA

SEQ ID NO: 14660 - protein, 479 aa, Homo sapiens
MSFQAPRRLLELAGQSLLRDQALAISVLDELPRELFPRLFVEAFTSRRCEVLKVMVQAWPFPCLPLGSLMKTPDLEILHYVVDGIDCLLAQKVRPRRWKLQVLEMRDVDENFWTIWSGARPLSCSPEAMSKRQTVEDCPRTGEKQPLKVFMDVCLKEKSVDEDLSFFSGWVQHRRRSVHLCCTKVVNYSMNILNFRNILETVYPDSIQVLEIWNMCWPCMVAEVSRYLSQMKNLRKLFISDGCGYLPSFESQGQLVAEFSSVFLRLEYLQMLYMRRIRFFEGYLDQLIRCLKSPLETLALTYGSLDEEDLKCLPWYPSLSQLKQLNLSHGTLRFIRLEPLRALLEKVAATLQTLFLVDCGIGYSKLRVILPALSRCSNLTTFCFHGNDTSMDGLKDLLRHTGRLSNLSLETYPAPRESLDNRGRVISELLTPLQAELMRILREVREPNRIFFGPVSCPCCGMSPTEQLEFNFCLRGRPA

SEQ ID NO: 14661 - protein, 474 aa, Homo sapiens
MSIQAPPRLLELAGQSLLRDQALSISAMEELPRVLYLPLFREAFSRRHFQTLTVMVQAWPFTCLPLVSLMKTLHLEPLKALLEGLHMLLTQKDRPRRWKLQVLDLRDVDENFWARWPGAWALSCFPEAMSKRQTAEDCPRTGEHQPLKVFIDICLKEIPQDECLRYLFQWVYQRRGLVHLCCSKLVNYLTPIKYLRKSLKIIYINSIGELEIHNTCWPHLIRKLYCYLKEMKTLCKLVFSRCHHYTSDNELEGWLVTRFTSVFLRLEHLQLLKIKLITFFSGHLEQLIRCLQNPLENLELTCGNLLEEDLKCLSQFPSLGYLKHLNLSYVLLFRISLEPLGALLEKIAASLETLVLEGCQIHYSQLSAILPGLSCCSQLTTFYFGSNCMSIDALKDLLRHTSGLSKLSLETYPAPEESLNSLVRVNWEIFTPLRAELMCTLREFRQPKRIFIGPTPCPSCGSSPSEELELHLCC

SEQ ID NO: 14662 - protein, 475 aa, Homo sapiens
MSIRTPPRLLELAGRSLLRDEALAISTLEELPTELFPPLFMEAFSRRHCEALKLMVQAWPFLRLPLGSLMKRPCPETFQAVLDGLDALLTHRVRLRRWKLQVLDLQDVSENFWMVWSEAMARRCLPNAMMNRKPVQDCPRMRGQQPLTVFIDLCLKNRTLDEYFTCLFLWVKQREGLVHLCCKKLKMLGMLFHNIRNILKTVNLDCIQEVEVNCNWTLPVLAEFTPYLGQMRNLRKLVLSDIDSRYISPEQKKEFVTQFTTQFLKLRCLQKLYMNSVSFLEGHLDQMLSCLKTSLNILAITNCVLLESDLKHLSKYPSIGQLKTLDLSGTRLANFSLVPLQVLLEKVAATLEYLDLDDCGIVDSQVNAILPALSRCFELTTFSFRGNPISTATLENLLCHTIRLNNLCLELYPAPRESYDVRGIVCRSRFAQLGAELMGRVRALREPERILFCTDYCPQCGNRSLYDLEVDRCCC

SEQ ID NO: 14663 - protein, 475 aa, Homo sapiens; identical to SEQ ID NO: 14662

SEQ ID NO: 14664 - protein, 475 aa, Homo sapiens; identical to SEQ ID NO: 14662

SEQ ID NO: 14665 - protein, 481 aa, Homo sapiens
MRMSLQAPRRLLELAGQSLLGDQALAISILDELPRELFPPLFVEAFTSRRCEVLKVMVQAWPFPCLPLGSLMKTPDLEILHYVVDGIDCLLAQKVRPRRWKLQVLELRDVDENFWTIWSGARPLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWPCMIVEFSRYLSQMRNLRKLFISDGCRYLLSSDSQEQLVAEFSSVLLRLEYLQMLYVRRVCFFRGHLDQLIRCLRSPLETLALTYGFLEKVDLKCLPRYPSLSQLKQLNLSHGALRFIRLEPLRALLEKVAATLQTLFLVDCGIRDSKLRVILPALSCCSNLTTFCFHGNDTSMDGLKDLLRHTGRLSNLSLETYPAPRESLDDRGRVISELLTPLQAELMRILREVREPKRIFFGPVSCPCCGTSPTEQLEFNFCLWGRPA

SEQ ID NO: 14666 - protein, 479 aa, Homo sapiens
MSLQAPRRLLELAGQSLLGDQALAISILDELPRELFPPLFVEAFTSRRCEVLKVMVQAWPFPCLPLGSLMKTPDLEILHYVVDGIDCLLAQKVRPRRRKLQVLELRDVDENFWTIWSGARPLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWPCMIVEFIRYLSQMRNLRKLFISDGCRYLLSSDSQEQLVAEFSSVLLRLEYLQMLYVRRVCFFRGHLDQLIRCLRSPLETLALTYGFLEKVDLKCLPRYPSLSQLKQLNLSHGALRFIRLEPLRALLEKVAATLQTLFLVDCGIRDSKLRVILPALSCCSNLTTFCFHGNDTSMDGLKDLLRHTGRLSNLSLETYPAPRESLDDRGRVISELLTPLQAELMRILREVREPKRIFFGPVSCPCCGTSPTEQLEFNFCLWGRPA

SEQ ID NO: 14667 - protein, 481 aa, Homo sapiens
MRMSLQAPRRLLELAGQSLLGDQALAISILDELPRELFPPLFVEAFTSRRCEVLKVMVQAWPFPCLPLGSLMKTPDLEILHYVVDGIDCLLAQKVRPRRRKLQVLELRDVDENFWTIWSGARPLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWPCMIVEFIRYLSQMRNLRKLFISDGCRYLLSSDSQEQLVAEFSSVLLRLEYLQMLYVRRVCFFRGHLDQLIRCLRSPLETLALTYGFLEKVDLKCLPRYPSLSQLKQLNLSHGALRFIRLEPLRALLEKVAATLQTLFLVDCGIRDSKLRVILPALSCCSNLTTFCFHGNDTSMDGLKDLLRHTGRLSNLSLETYPAPRESLDDRGRVISELLTPLQAELMRILREVREPKRIFFGPVSCPCCGTSPTEQLEFNFCLWGRPA

SEQ ID NO: 14668 - protein, 478 aa, Homo sapiens
MKMSIWTPPRLLELAGRSLLRDQALAMSTLEELPTELFPPLFMEAFSRRRCEALKLMVQSWPFRRLPLRPLIKMPCLEAFQAVLDGLDALLNLGVRPRRWKLQVLDLQDVCENFWMVWSEAMAHGCFLNAKRNKKPVEDCPRMRGRQPLTVFVELWLKNRTLDEYLTCLLLWVKQRKDLLHLCCKKLKILGMPFRNIRSILKMVNLDCIQEVEVNCKWVLPILTQFTPYLGHMRNLQKLILSHMDVSRYVSPEQKKEIVTQFTTQFLKLRCLQKLYMNSVSFLEGHLDQLLSCLKTSLKFLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCVELYPAPRESYGADGTLCWSRFAQIRAELMNRVRDLRHPKRILFCTDYCPDCGNRSFYDLEADQYCC

SEQ ID NO: 14669 - protein, 476 aa, Homo sapiens
MSIRTPPRLLELAGRSLLRDQALAMSTLEELPTELFPPLFMEAFSRRRCEALKLMVQAWPFRRLPLRPLIKMPCLEAFQAVLDGLDALLTQGVHPRRWKLQVLDLQDVCENFWMVWSEAMAHGCFLNAKRNKKPVQDCPRMRGQQPLTVFVELWLKNRTLDEYLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLCCLQKLSMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCVELYPAPRESYDADGTLCWSRFAQIRAELMKRVRDLRHPKRILFCTDCCPDCGNRSFYDLEADQCCC

SEQ ID NO: 14670 - protein, 476 aa, Homo sapiens
MSIRTPPRLLELAGRSLLRDQALAMSTLEELPTELFPPLFMEAFSRRRCEALKLMVQAWPFRRLPLRPLIKMPCLEAFQAVLDGLDALLTQGVHPRRWKLQVLDLQDVCENFWMVWSEAMARGCFLNAKRNKTPVQDCPRMRGQQPLTVFVELWLKNRTLDEYLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLCCLQKLSMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCVELYPAPRESYDADGTLCWSRFAQIRAELMKRVRDLRHPKRILFCTDCCPDCGNRSFYDLEADQCCC

SEQ ID NO: 14671 - protein, 476 aa, Homo sapiens
MSIRTPPRLLELAGRSLLRDQALAMSTLEELPTELFPPLFMEAFSRRRCEALKLMVQAWPFRRLPLRPLIKMPCLEAFQAVLDGLDALLTQGVHPRRWKLQVLDLQDVCENFWMVWSEAMAHGCFLNAKRNKKPVQDCPRMRGQQPLTVFVELWLKNRTLDEYLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLCCLQKLSMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSCCFELNTFSFCGNPISMATLENLLSHTIILKNLCVELYPAPRESYDADGTLCWSRFPQIRAELMKRVRDLRHPKRILFCTDCCPDCGNRSFYDLEADQCCC

SEQ ID NO: 14672 - protein, 476 aa, Homo sapiens; identical to SEQ ID NO: 14670

SEQ ID NO: 14673 - protein, 476 aa, Homo sapiens; identical to SEQ ID NO: 14669

SEQ ID NO: 14674 - protein, 476 aa, Homo sapiens; identical to SEQ ID NO: 14671

SEQ ID NO: 14675 - protein, 476 aa, Homo sapiens; identical to SEQ ID NO: 14670

SEQ ID NO: 14676 - protein, 474 aa, Homo sapiens
MSIRAPPRLLELARQRLLRDQALAISTMEELPRELFPTLFMEAFSRRRCETLKTMVQAWPFTRLPLGSLMKSPHLESLKSVLEGVDVLLTQEVRPRQSKLQVLDLRNVDENFCDIFSGATASFPEALSQKQTADNCPGTGRQQPFMVFIDLCLKNRTLDECLTHLLEWGKQRKGLLHVCCKELQVFGMPIHSIIEVLNMVELDCIQEVEVCCPWELSTLVKFAPYLGQMRNLRKLVLFNIRASACIPPDNKGQFIARFTSQFLKLDYFQNLSMHSVSFLEGHLDQLLRCLQASLEMVVMTDCLLSESDLKHLSWCPSIRQLKELDLRGVTLTHFSPEPLTGLLEQVVATLQTLDLEDCGIMDSQLSAILPVLSRCSQLSTFSFCGNLISMAALENLLRHTVGLSKLSLELYPAPLESYDTQGALCWGRFAELGAELMKTPRDLRQPKIIVFCTVPCPRCGIRASYDLEPSHCLC

SEQ ID NO: 14677 - protein, 474 aa, Homo sapiens; identical to SEQ ID NO: 14676

SEQ ID NO: 14678 - protein, 474 aa, Homo sapiens
MSIRAPPRLLELARQRLLRDQALAISTMEELPRELFPTLFMEAFSRRRCETLKTMVQAWPFTRLPLGSLMKSPHLESLKSVLEGVDVLLTQEVRPRQSKLQVLDLRNVDENFCDIFSGATASFPEALSQKQTADNCPGTGRQQPFMVFIDLCLKNRTLDECLTHLLEWGKQRKGLLHVCCQELQVFGMPIHSIIEVLNMVELDCIQEVEVCCPWELSTLVKFAPYLGQMRNLRKLVLFNIRASACIPPDNKGQFIARFTSQFLKLDYFQNLSMHSVSFLEGHLDQLLRCLQASLEMVVMTDCLLSESDLKHLSWCPSIRQLKELDLRGVTLTHFSPEPLTGLLEQVVATLQTLDLEDCGIMDSQLSAILPVLSRCSQLSTFSFCGNLISMAALENLLRHTVGLSKLSLELYPAPLESYDTQGALCWGRFAELGAELMKTLRDLRQPKIIVFCTVPCPRCGIRASYDLEPSHCLC

SEQ ID NO: 14679 - protein, 478 aa, Homo sapiens; identical to SEQ ID NO: 14654

SEQ ID NO: 14680 - protein, 173 aa, Homo sapiens
MFARGSRRRRSGRAPPEAEDPDRGQPCNSCREQCPGFLLHGWRKICQHCKCPREEHAVHAVPVDLERIMCRLISDFQRHSISDDDSGCASEEYAWVPPGLKPEQVYQFFSCLPEDKVPYVNSPGEKYRIKQLLHQLPPHDSEVRREKTGRACQAQHTAWANAGQGQRRKGELI

SEQ ID NO: 14681 - protein, 615 aa, Homo sapiens
MFARGSRRRRSGRAPPEAEDPDRGQPCNSCREQCPGFLLHGWRKICQHCKCPREEHAVHAVPVDLERIMCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGLDQGQMAYEGQHWHASDRCFCCSRCGRALLGRPFLPRRGLIFCSRACSLGSEPTAPGPSRRSWSAGPVTAPLAASTASFSAVKGASETTTKGTSTELAPATGPEEPSRFLRGAPHRHSMPELGLRSVPEPPPESPGQPNLRPDDSAFGRQSTPRVSFRDPLVSEGGPRRTLSAPPAQRRRPRSPPPRAPSRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 14682 - protein, 150 aa, Homo sapiens
MFARGSRRRRSGRAPPEAEDPDRGQPCNSCREQCPGFLLHGWRKICQHCKCPREEHAVHAVPVDLERIMCRLISDFQRHSISDDDSGCASEEYAWVPPGLKPEQVTRGQPSTLAVQWVHTNAHTHTHTQVGTYFWGYARVCSQTEGPSGP

SEQ ID NO: 14683 - protein, 331 aa, Homo sapiens
  MOD_RES (1)..(1): Any amino acid
XPPLPRLCPAPPHSGRCPSLPSAAQPPEAEDPDRGQPCNSCREQCPGFLLHGWRKICQHCKCPREEHAVHAVPVDLERIMCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGG

SEQ ID NO: 14684 - protein, 628 aa, Homo sapiens
  MOD_RES (1)..(1): Any amino acid
XVEGRALTSPSLLPRLTRPCICPRPLQPPEAEDPDRGQPCNSCREQCPGFLLHGWRKICQHCKCPREEHAVHAVPVDLERIMCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGLDQGQMAYEGQHWHASDRCFCCSRCGRALLGRPFLPRRGLIFCSRACSLGSEPTAPGPSRRSWSAGPVTAPLAASTASFSAVKGASETTTKGTSTELAPATGPEEPSRFLRGAPHRHSMPELGLRSVPEPPPESPGQPNLRPDDSAFGRQSTPRVSFRDPLVSEGGPRRTLSAPPAQRRRPRSPPPRAPSRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 14685 - protein, 534 aa, Homo sapiens
MCRLISDFQRHSISDDDSGCASEEYAWVPPGLKPEQVTRGQPSTLAVQWVHTNAHTHTHTQAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGLDQGQMAYEGQHWHASDRCFCCSRCGRALLGRPFLPRRGLIFCSRACSLGSEPTAPGPSRRSWSAGPVTAPLAASTASFSAVKGASETTTKGTSTELAPATGPEEPSRFLRGAPHRHSMPELGLRSVPEPPPESPGQPNLRPDDSAFGRQSTPRVSFRDPLVSEGGPRRTLSAPPAQRRRPRSPPPRAPSRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 14686 - protein, 439 aa, Homo sapiens
MFARGSRRRRSGRAPPEAEDPDRGQPCNSCREQCPGFLLHGWRKICQHCKCPREEHAVHAVPVDLERIMCRLISDFQRHSISDDDSGCASEEYAWVPPGLKPEQVTRGQPSTLAVQWVHTNAHTHTHTQAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTPGPRPGPEEPSRFLRGAPHRHSMPELGLRSVPEPPPESPGQPNLRPDDSAFGRQSTPRVSFRDPLVSEGGPRRTLSAPPAQRRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 14687 - protein, 547 aa, Homo sapiens
MCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGLDQGQMAYEGQHWHASDRCFCCSRCGRALLGRPFLPRRGLIFCSRACSLGSEPTAPGPSRRSWSAGPVTAPLAASTASFSAVKGASETTTKGTSTELAPATGPEEPSRFLRGAPHRHSMPELGLRSVPEPPPESPGQPNLRPDDSAFGRQSTPRVSFRDPLVSEGGPRRTLSAPPAQRRRPRSPPPRAPSRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 14688 - protein, 554 aa, Homo sapiens
MHINFHRPPAKPKPQKVKEIEYQNLRFPVDLSNPFAVATVLNQEPGKLKIKELREVLDQGTEISKTRQMKEALFEQKVRQDIHEEMENHLKWQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSVLSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 14689 - protein, 840 aa, Homo sapiens
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESKTYVIPLQCSCPVDFEFYITLIQSHQAFAIEPTSGIIPANGKMTVTIKFTPFQYGTAQIKMQLWISQFNSQPYECVFTGTCYPNMALPLEEFERLNTLSKKVNVPPEKAMMHINFHRPPAKPKPQKVKEIEYQNLRFPVDLSNPFAVATVLNQEPGKLKIKELREVLDQGTEISKTRQMKEALFEQKVRQDIHEEMENHLKWQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSVLSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 14690 - protein, 187 aa, Homo sapiens
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESLPNSVFLVPDN

SEQ ID NO: 14691 - protein, 399 aa, Homo sapiens
  MOD_RES (1)..(1): Any amino acid
XHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSVLSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 14692 - protein, 554 aa, Homo sapiens; identical to SEQ ID NO: 14688

SEQ ID NO: 14693 - protein, 184 aa, Homo sapiens
MASPAASSVRPPRPKKEPQTLVIPKNAAEEQKLKLERLMKNPDKAVPIPEKMSEWAPRPPPEFVRDVMGSSAGAGSGEFHVYRHLRRREYQRQDYMDAMAEKQKLDAEFQKRLEKNKIAAEEQTAKRRKKRQKLKEKKLLAKKMKLEQKKQEGPGQPKEQGSSSSAEASGTEEEEEVPSFTMGR

SEQ ID NO: 14694 - protein, 261 aa, Homo sapiens
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVALSKNPGYIKLRKIRAAQNISKTIATSQNRIYLTADNLVLNLQDESFTRGSDSLIKGKK

SEQ ID NO: 14695 - protein, 922 aa, Homo sapiens
MDKKSFEMVLDEIRKVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 14696 - protein, 944 aa, Homo sapiens
MDKKSFEMVLDEIRKAVLTEYKLKAIEYVHGYFSSEQVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 14697 - protein, 1040 aa, Homo sapiens
MAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDPCGCCCCPLSTLALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRLLPVPCKPSPSASEKIALRSPLCSEALVTCAALTHPRVPPLQPMGPTCPTPAPVPLRPHRPSGPHRSILRAPCPQWAPCPQQAPCSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 14698 - protein, 1274 aa, Homo sapiens
MAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNIVSGICHLFRALAQDTRQPGKYWGPESPQTVSSWSRPRELPTFVQITSLPMCRDTGAQCQSVANASLGEGEFGDAESLLRGPAILLTFHPGSILEDRGLILLGELRSGVGFLTYVYICKWSFPVSVSLWLSLSSSTLYLCPFFLQSLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 14699 - protein, 906 aa, Homo sapiens
MELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 14700 - protein, 1180 aa, Homo sapiens
MLLPSLSPRVQPAFTQCARPQPPPHAPSPVGGRRGVFASSRHATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 14701 - protein, 360 aa, Homo sapiens
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERSPGGTPLTNKENMETGTGLTPVMTQALRRKFQLAHPRSPTPTLPLSTSSFDEQN

SEQ ID NO: 14702 - protein, 1216 aa, Homo sapiens
MEQLPGVPPGPPHPVRPPPPNPPPPMPLQLEAHLRSHGLEPAAPSPRLRPEESLDPPGAMQELLGALEPLPPAPGDTGVGPPNSEGKDPAGAYRSPSPQGTKAPRFVPLTSICFPDSLLQDEERSFFPTMEEMFGGGAADDYGKAGPPEDEGDPKAGAGPPPGPPAYDPYGPYCPGRASGAGPETPGLGLDPNKPPELPSTVNAEPLGLIQSGPHQAAPPPPPPPPPPPAPASEPKGGLTSPIFCSTKPKKLLKTSSFHLLRRRDPPFQTPKKLYAQEYEFEADEDKADVPADIRLNPRRLPDLVSSCRSRPALSPLGDIDFCPPNPGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSANSNGTPEPPLLEEKPPPTPPPAPTPQPQPPPPPPPPQPALPSPPPLVAPTPSSPPPPPLPPPPPPAMPSPPPPPPPAAAPLAAPPEEPAAPSPEDPELPDTRPLHLAKKQETAAVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHDELYLPPMRKIDGLLNEHKKKVLKRLSLSPALQDALHTFPQLQVEQSGEGSPEEGAVRLRPAGEPYNRKTLSKLKRSVVRAQEFKVELEKSGYYTLYHSLHHYKYHTFLRCRDQTLAIEGGAEDLGQEEVVQQCMRNQPWLEQLFDSFSDLLAQAQAHSRCG

SEQ ID NO: 14703 - protein, 1144 aa, Homo sapiens
MEQLPGVPPGPPHPVRPPPPNPPPPMPLQLEAHLRSHGLEPAAPSPRLRPEESLDPPGAMQELLGALEPLPPAPGDTGVGPPNSEGKDPAGAYRSPSPQGTKAPRFVPLTSICFPDSLLQDEERSFFPTMEEMFGGGAADDYGKAGPPEDEGDPKAGAGPPPGPPAYDPYGPYCPGRASGAGPETPGLGLDPNKPPELPSTVNAEPLGLIQSGPHQAAPPPPPPPPPPPAPASEPKGGLTSPIFCSTKPKKLLKTSSFHLLRRRDPPFQTPKKLYAQEYEFEADEDKADVPADIRLNPRRLPDLVSSCRSRPALSPLGDIDFCPPNPGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSANSNGTPEPPLLEEKPPPTPPPAPTPQPQPPPPPPPPQPALPSPPPLVAPTPSSPPPPPLPPPPPPAMPSPPPPPPPAAAPLAAPPEEPAAPSPEDPELPDTRPLHLAKKQETAAVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHELKRSVVRAQEFKVELEKSGYYTLYHSLHHYKYHTFLRCRDQTLAIEGGAEDLGQEEVVQQCMRNQPWLEQLFDSFSDLLAQAQAHSRCG

SEQ ID NO: 14704 - protein, 2036 aa, Homo sapiens
MDRNYPSAGFGDPLGAGAGWSYERSAKASLVYGSSRTSHPETDILHRQAYAAPHPLQSYATNHHPAGLSGLFDTGLHHAGSAGPDASVMNLISALESRGPQPGPSASSLLSQFRSPSWQTAMHTPGPTELFISGALPGSSTFPSSSALSAYQHPASFGSRPFPVPSSLSLQDPPFSPPANGLLSPHDVLHLKPSQAPTVPSSLGFERLAGGGVLGPAGLGPAQTPPYRPGPPDPPPPPRHLPTQFNLLASSSAAAAAAEQSSPQLYNFSGAAPGPPPPERALPRQDTVIKHYQRPASAQPPPPPPPAHALQHYLSCGGSYPSMGHRANLACSPLGGGEPSPGAGEPSKAGPSGATAGASGRATGPEAAGGGGAGGGGGGYRPIIQSPGYKTGKGGYGAAAGGATRPPPPRSTATPKCQSLGGPAAAYATGKASGAGGAGGQAYSPGQPQGLLGPQAYGQGFGGGQAQDLSKAPSYSGGPPQPPSGPPPPGLATCQSYSPDQLQGQLYGVQGEPYPGPAAHSQGLPTASPSLSYSTGHSPALSGHGGGWGPSSLGGGGEASPSHIIRPLQSPPATGRPPGVGSPGAPGKYLSSVLASAPFLAPPGAGSYAAGAGGYKGKGDGSELLAGPGGPPAERTEDEEFLIQHLLQAPSPPRTSGADGLVGEDGAADASKGLGGSGGAGGPPGTPYELAKEDPQRYHLQSVIRTSASLDEGATAALELGLGRLKEKKKGPERGGETPEGLATSVVHYGAGAKELGAFLQKSPPPPPPTAQSTQPTPHGLLLEAGGPDLPLVLPPPPPQLLPSVLSHAPSPSPSASKVGVHLLEPATRDGAPQPPPPPPPPPPPMPLQLEAHLRSHGLEPAAPSPRLRPEESLDPPGAMQELLGALEPLPPAPGDTGVGPPNSEGKDPAGAYRSPSPQGTKAPRFVPLTSICFPDSLLQDEERSFFPTMEEMFGGGAADDYGKAGPPEDEGDPKAGAGPPPGPPAYDPYGPYCPGRASGAGPETPGLGLDPNKPPELPSTVNAEPLGLIQSGPHQAAPPPPPPPPPPPAPASEPKGGLTSPIFCSTKPKKLLKTSSFHLLRRRDPPFQTPKKLYAQEYEFEADEDKADVPADIRLNPRRLPDLVSSCRSRPALSPLGDIDFCPPNPGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSANSNGTPEPPLLEEKPPPTPPPAPTPQPQPPPPPPPPQPALPSPPPLVAPTPSSPPPPPLPPPPPPAMPSPPPPPPPAAAPLAAPPEEPAAPSPEDPELPDTRPLHLAKKQETAAVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHDELYLPPMRKIDGLLNEHKKKVLKRLSLSPALQDALHTFPQLQVEQSGEGSPEEGAVRLRPAGEPYNRKTLSKLKRSVVRAQEFKVELEKSGYYTLYHSLHHYKYHTFLRCRDQTLAIEGGAEDLGQEEVVQQCMRNQPWLEQLFDSFSDLLAQAQAHSRCG

SEQ ID NO: 14705 - protein, 558 aa, Homo sapiens
GRPLGGDARREGASVGGTSRDWSEEGICLTVDPWGSTLSSEMLQLGPPLSERSFAALKLTGEGKASPGRQAGWSSQARPPDPLCLCREPLSRIHRTSSTLRRRSRTTPGPEEGPSQKVDRAPQPTLVVMLEDIASPRPPAEGFIDETPNFIIPAQRAEPMRIVRQPTPPPGDLEPPFQPSALPADPLESPPTAPDPALELPSTPPPSSLLRPRLSPWGLAPLFRSVRSKLESFADIFLTPNKTPQPPPPSPPMKLELKIAISEAEQSGAAEGTASVSPRPPIRQWRTQDHNTPALLPKPSLGRSYSCPDLGPPGPGTCTWPPAPPQPSRPRPRRHTVGGGEMARAPPPPRPCLRKEVFPLGGVGASPSLTTSCSSTASTSFSEPAEPRLGSTKGKEPRASKDQVLSEPETKTMGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 14706 - protein, 585 aa, Homo sapiens
MDLPGDSSPPGQPRLCRQPLTRALWGARSPKRPRLQLPGAPSPLEKASRRVLAVVLEDVMAVHMVPVVPSKQTSIPQHHSYHQDPVHRQPPASPPRQAGWSSQARPPDPLCLCREPLSRIHRTSSTLRRRSRTTPGPEEGPSQKVDRAPQPTLVVMLEDIASPRPPAEGFIDETPNFIIPAQRAEPMRIVRQPTPPPGDLEPPFQPSALPADPLESPPTAPDPALELPSTPPPSSLLRPRLSPWGLAPLFRSVRSKLESFADIFLTPNKTPQPPPPSPPMKLELKIAISEAEQSGAAEGTASVSPRPPIRQWRTQDHNTPALLPKPSLGRSYSCPDLGPPGPGTCTWPPAPPQPSRPRPRRHTVGGGEMARAPPPPRPCLRKEVFPLGGVGASPSLTTSCSSTASTSFSEPAEPRLGSTKGKEPRASKDQVLSEPETKTMGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 14707 - protein, 585 aa, Homo sapiens; identical to SEQ ID NO: 14706

SEQ ID NO: 14708 - protein, 2149 aa, Homo sapiens
MLSSGVETQPVPLDSSMSAVVQELYSELPVSVSRELHADPEPSVIPDVKPGASSSLLSQNRALPLELQRTHVESCCEETYETLDHGSEPGRCGLVDSTAGGSVASGILDRAKRSESMEPKVFRDPGGQAGIIREPSEGAKEDPHQHSTAAEEKTSPSQEDLLMQSSKELSHVDLPEDFLRSKEGNVQITAETLLKSAEVQGMKVNGTKTDNNEGHKNGNVSKDLSAGCGEFQEVDKIMTSDEVSETSTLVTPEPLTFVDPVLTEATPKEKECEELKSCPWLSLPGNSAISNVDNGKEELCKPNLVCEADDNHQQLHGHHNEQPSSTHDSPTATSPLKENSEVSCFTSDLSGPESRTISLENCGFEGGGLLKRSAEKTDSSYFYRGDDQGKNLASREENEERLLIPRSERGGPFLFNAREPEKEISGRCSGEKEPVVSPKENIHNNCIQDSLHTGNSSSLMPNSFTEATEVMLNKNDLKITVHVQGNLTNPEDHKETFTNMSHPGGHSEESSFSSLMQIEEAGQTTPVEPNILSKSFYTKDCNSLVSIQRNLEGNTQLNEASCNDFLFERKSIVSLMPEDQISPVSEVLKPKQGTALLLPSPEFDYRPESEKVIQTSHDDIPLLDEQSIACEMNELSCTNELVVNKVESECVLNQQVSLNSQEHANLPTDSLLHLNKEMPLATGRDAHQSHHPPLEGRADVIADIQTIPIQTKIKDISPPGNQTCGASSNCPTLNIKPVSLERKKEMADSGTKALHSRLRSNKREAAGFPQVVSVIECHSVQSQDISSCHRVRKNVSQENMCSASAAFKSSKISLQVDNSLITKYENAFQHRDHCCQGTGHSVEKSSCKVSYTSQERELDGKETNGSLPGDKIRNKMVAGLLNSGISNKTIHTSSSIKLSEEGLEGKEQDVSKETVFCKYNISDHAIQELNQTVNIPGPEKVLDQSPTVMFSSFKNVKSVETLDQKADEVLDCQSNQNRPDECKSEGQSAKEMLSSDQRETVTEPHGEVNHNQKDLLVSSGSNNSLPCGSPKKCNLKGAFVKMSGCDESTEGMVDIVYTDCSNKLAEGVLDVKASNLLDCGARQEKLAFQEDSRSTLSRRELDAAHTGTTGQDSDFPVTAASTVDFLKIKKSCEENVCRSLKDCEMEKCPDSCAHEMESVADHEPNKRILGRVNLSLNDSHYGQQDKGTSLRETQEMTEGSRLEPNSEFGKESTFGISSKESMSCHDESSVSLRSLKSIEIMPSQENSETNVNSEETDLKNLCKPKDGEMLCENVKDCTVLPEMKEIVSRDWSNSSDRDSVCTCVEKNACKACHPHENSSDRHLPLTVKTDIKVKGEETEEHQRGRLGYLTVGEQSEELVTRETGDGDPVSNISQTHFKCRGILNHAEKQQSPEVLDYMLQKEEKYIRQQKAHTISQQCISSSLLLDDAQNQNQPKADKDESTMINEITLAKLAKDSIVAQTQKLEDQKEERLHHPLRKDTESCTSPCLLGAPRKAQDPSSAGCDQIHGAFAKKGVLPLKKQPHRTCKKVSYQEQIIVGRKIGKIRSSAFLKSSSNPIPTKAHRLLSLCTLSAPTRLEPETAPTKSLVSHIPKQMSTPCHPLRSLNFRKTTKESALLNKLSILASKLAPAMKTQKLRYRRCSSELLPMAKSYKRLRYKRLLDGFSSSTEQLNPYLAASGWDKRPNSKPMALYSLESIKMTFIDLSNKMPSLLFGSEIFPVSFHVKSSSSDCTTESSRTFPEHCAPARLALGEALQCPSQPPKWTFSFFLSHGCPGMATFREDTGVHSQTHTQAPPQPPAPLQDYGGTAIVQTRADCSVLGLHTLLALCSPGCYRIWTKKRSFSSHMPTMQRLFMTQFTQGLKGLRSPASIADKVFCSLPYSVGRVLSIWSQHGPSVCSFEISSLHSPHCKRQPSLGTTSSHTMLPYVPLPGMEATYNTSGSQTRLEPPFPALVPKSCLVAESAVSKLLLSASEFQVRGLDELDGVKAACPCPQSSPPEQKEAEPEKRPKKVSQIRIRKTIPRPDPNLTPMGLPRPKRLKKKEFSLEEIYTNKNYKSPPANRDLDSSCPSTDSETGHFLVFGYAQRQAQPHPLLASRRLIGCSSPEGRGHPRSYPYWRRLLVLCWYLPGWRAGRVTWLRLATWAGRGDSSL

SEQ ID NO: 14709 - protein, 2006 aa, Homo sapiens
MLSSGVETQPVPLDSSMSAVVQELYSELPVSVSRELHADPEPSVIPDVKPGASSSLLSQNRALPLELQRTHVESCCEETYETLDHGSEPGRCGLVDSTAGGSVASGILDRAKRSESMEPKVFRDPGGQAGIIREPSEGAKEDPHQHSTAAEEKTSPSQEDLLMQSSKELSHVDLPEDFLRSKEGNVQITAETLLKSAEVQGMKVNGTKTDNNEGHKNGNVSKDLSAGCGEFQEVDKIMTSDEVSETSTLVTPEPLTFVDPVLTEATPKEKECEELKSCPWLSLPGNSAISNVDNGKEELCKPNLVCEADDNHQQLHGHHNEQPSSTHDSPTATSPLKENSEVSCFTSDLSGPESRTISLENCGFEGGGLLKRSAEKTDSSYFYRGDDQGKNLASREENEERLLIPRSERGGPFLFNAREPEKEISGRCSGEKEPVVSPKENIHNNCIQDSLHTGNSSSLMPNSFTEATEVMLNKNDLKITVHVQGNLTNPEDHKETFTNMSHPGGHSEESSFSSLMQIEEAGQTTPVEPNILSKSFYTKDCNSLVSIQRNLEGNTQLNEASCNDFLFERKSIVSLMPEDQISPVSEVLKPKQGTALLLPSPEFDYRPESEKVIQTSHDDIPLLDEQSIACEMNELSCTNELVVNKVESECVLNQQVSLNSQEHANLPTDSLLHLNKEMPLATGRDAHQSHHPPLEGRADVIADIQTIPIQTKIKDISPPGNQTCGASSNCPTLNIKPVSLERKKEMADSGTKALHSRLRSNKREAAGFPQVVSVIECHSVQSQDISSCHRVRKNVSQENMCSASAAFKSSKISLQVDNSLITKYENAFQHRDHCCQGTGHSVEKSSCKVSYTSQERELDGKETNGSLPGDKIRNKMVAGLLNSGISNKTIHTSSSIKLSEEGLEGKEQDVSKETVFCKYNISDHAIQELNQTVNIPGPEKVLDQSPTVMFSSFKNVKSVETLDQKADEVLDCQSNQNRPDECKSEGQSAKEMLSSDQRETVTEPHGEVNHNQKDLLVSSGSNNSLPCGSPKKCNLKGAFVKMSGCDESTEGMVDIVYTDCSNKLAEGVLDVKASNLLDCGARQEKLAFQEDSRSTLSRRELDAAHTGTTGQDSDFPVTAASTVDFLKIKKSCEENVCRSLKDCEMEKCPDSCAHEMESVADHEPNKRILGRVNLSLNDSHYGQQDKGTSLRETQEMTEGSRLEPNSEFGKESTFGISSKESMSCHDESSVSLRSLKSIEIMPSQENSETNVNSEETDLKNLCKPKDGEMLCENVKDCTVLPEMKEIVSRDWSNSSDRDSVCTCVEKNACKACHPHENSSDRHLPLTVKTDIKVKGEETEEHQRGRLGYLTVGEQSEELVTRETGDGDPVSNISQTHFKCRGILNHAEKQQSPEVLDYMLQKEEKYIRQQKAHTISQQCISSSLLLDDAQNQNQPKADKDESTMINEITLAKLAKDSIVAQTQKLEDQKEERLHHPLRKDTESCTSPCLLGAPRKAQDPSSAGCDQIHGAFAKKGVLPLKKQPHRTCKKVSYQEQIIVGRKIGKIRSSAFLKSSSNPIPTKAHRLLSLCTLSAPTRLEPETAPTKSLVSHIPKQMSTPCHPLRSLNFRKTTKESALLNKLSILASKLAPAMKTQKLRYRRCSSELLPMAKSYKRLRYKRLLDGFSSSTEQLNPYLAASGWDKRPNSKPMALYSLESIKMTFIDLSNKMPSLLFGSEIFPVSFHVKSSSSDCTTESSRTFPEHCAPARLALGEALQCPSQPPKWTFSFFLSHGCPGMATFREDTGVHSQTHTQAPPQPPAPLQDYGGTAIVQTRADCSVLGLHTLLALCSPGCYRIWTKKRSFSSHMPTMQRLFMTQFTQGLKGLRSPASIADKVFCSLPYSVGRVLSIWSQHGPSVCSFEISSLHSPHCKRQPSLGTTSSHTMLPYVPLPGMEATYNTSGSQTRLEPPFPALVPKSCLVAESAVSKLLLSASEFQVRGLDELDGVKAACPCPQSSPPEQKEVKEEGV

SEQ ID NO: 14710 - protein, 2151 aa, Homo sapiens
MLSSGVETQPVPLDSSMSAVVQELYSELPVSVSRELHADPEPSVIPDVKPGASSSLLSQNRALPLELQRTHVESCCEETYETLDHGSEPGRCGLVDSTAGGSVASGILDRAKRSESMEPKVFRDPGGQAGIIREPSEGAKEDPHQHSTAAEEKTSPSQEDLLMQSSKELSHVDLPEDFLRSKEGNVQITAETLLKSAEVQGMKVNGTKTDNNEGHKNGNVSKDLSAGCGEFQEVDKIMTSDEVSETSTLVTPEPLTFVDPVLTEATPKEKECEELKSCPWLSLPGNSAISNVDNGKEELCKPNLVCEADDNHQQLHGHHNEQPSSTHDSPTATSPLKENSEVSCFTSDLSGPESRTISLENCGFEGGGLLKRSAEKTDSSYFYRGDDQGKNLASREENEERLLIPRSERGGPFLFNAREPEKEISGRCSGEKEPVVSPKENIHNNCIQDSLHTGNSSSLMPNSFTEATEVMLNKNDLKITVHVQGNLTNPEDHKETFTNMSHPGGHSEESSFSSLMQIEEAGQTTPVEPNILSKSFYTKDCNSLVSIQRNLEGNTQLNEASCNDFLFERKSIVSLMPEDQISPVSEVLKPKQGTALLLPSPEFDYRPESEKVIQTSHDDIPLLDEQSIACEMNELSCTNELVVNKVESECVLNQQVSLNSQEHANLPTDSLLHLNKEMPLATGRDAHQSHHPPLEGRADVIADIQTIPIQTKIKDISPPGNQTCGASSNCPTLNIKPVSLERKKEMADSGTKALHSRLRSNKREAAGFPQVVSVIECHSVQSQDISSCHRVRKNVSQENMCSASAAFKSSKISLQVDNSLITKYENAFQHRDHCCQGTGHSVEKSSCKVSYTSQERELDGKETNGSLPGDKIRNKMVAGLLNSGISNKTIHTSSSIKLSEEGLEGKEQDVSKETVFCKYNISDHAIQELNQTVNIPGPEKVLDQSPTVMFSSFKNVKSVETLDQKADEVLDCQSNQNRPDECKSEGQSAKEMLSSDQRETVTEPHGEVNHNQKDLLVSSGSNNSLPCGSPKKCNLKGAFVKMSGCDESTEGMVDIVYTDCSNKLAEGVLDVKASNLLDCGARQEKLAFQEDSRSTLSRRELDAAHTGTTGQDSDFPVTAASTVDFLKIKKSCEENVCRSLKDCEMEKCPDSCAHEMESVADHEPNKRILGRVNLSLNDSHYGQQDKGTSLRETQEMTEGSRLEPNSEFGKESTFGISSKESMSCHDESSVSLRSLKSIEIMPSQENSETNVNSEETDLKNLCKPKDGEMLCENVKDCTVLPEMKEIVSRDWSNSSDRDSVCTCVEKNACKACHPHENSSDRHLPLTVKTDIKVKGEETEEHQRGRLGYLTVGEQSEELVTRETGDGDPVSNISQTHFKCRGILNHAEKQQSPEVLDYMLQKEEKYIRQQKAHTISQQCISSSLLLDDAQNQNQPKADKDESTMINEITLAKLAKDSIVAQTQKLEDQKEERLHHPLRKDTESCTSPCLLGAPRKAQDPSSAGCDQIHGAFAKKGVLPLKKQPHRTCKKVSYQEQIIVGRKIGKIRSSAFLKSSSNPIPTKAHRLLSLCTLSAPTRLEPETAPTKSLVSHIPKQMSTPCHPLRSLNFRKTTKESALLNKLSILASKLAPAMKTQKLRYRRCSSELLPMAKSYKRLRYKRLLDGFSSSTEQLNPYLAASGWDKRPNSKPMALYSLESIKMTFIDLSNKMPSLLFGSEIFPVSFHVKSSSSDCTTESSRTFPEHCAPARLALGEALQCPSQPPKWTFSFFLSHGCPGMATFREDTGVHSQTHTQAPPQPPAPLQDYGGTAIVQTRADCSVLGLHTLLALCSPGCYRIWTKKRSFSSHMPTMQRLFMTQFTQGLKGLRSPASIADKVFCSLPYSVGRVLSIWSQHGPSVCSFEISSLHSPHCKRQPSLGTTSSHTMLPYVPLPGMEATYNTSGSQTRLEPPFPALVPKSCLVAESAVSKLLLSASEFQVRGLDELDGVKAACPCPQSSPPEQKEAEPEKRPKKVSQIRIRKTIPRPDPNLTPMGLPRPKRLKKKEFSLEEIYTNKNYKSPPANRCLETIFEEPKERNGTLISISQQKRKRVLEFQDFTVPRKRRARGKVKVAGSFTRAQKAAVQSRELDALLIQKLMELETFFAKEEEQEQSSGC

SEQ ID NO: 14711 - protein, 129 aa, Homo sapiens
MADSGDAGSSGPWWKSLTNSRKKSKEAAVGVPPPAQPAPGEPTPPAPPSPDWTSSSRENQHPNLLGGAGEPPKPDKLYGDKSGSSRRNLKISRSGRFKEKRKVRATLLPEAGRSPEEAGFPGDPHEDKQ

SEQ ID NO: 14712 - protein, 18 aa, Homo sapiens
MADSGDAGSSGPWWKSLT

SEQ ID NO: 14713 - protein, 103 aa, Homo sapiens
MTTEIGWWKLTFLRKKKSTPKVLYEIPDTYAQTEGDAEPPRPDAGGPNSDFNTRLEKIVDKSTKGKHVKVSNSGRFKEKKKVRATLAENPNLFDDHEEGRSSK

SEQ ID NO: 14714 - protein, 281 aa, Homo sapiens
MAQSGLTATSASQVQAILLPQPASVRHYAWVVDQIDTLTSDLQLEDEMTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 14715 - protein, 304 aa, Homo sapiens
MSAKSKGNPSSSCPAEGPPAASKTKVKEQIKIIVEDLELVLGDLKDVAKELKEVVDQIDTLTSDLQLEDEMTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 14716 - protein, 234 aa, Homo sapiens
MTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 14717 - protein, 234 aa, Homo sapiens; identical to SEQ ID NO: 14716

SEQ ID NO: 14718 - protein, 142 aa, Homo sapiens
MTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQ

SEQ ID NO: 14719 - protein, 356 aa, Homo sapiens
MDTQGPVSQPFQQPEKPGRVRRRKTRRERNKALVGSRRPLAHHDPPVAIRDPPVVPTASKLVVITQGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIQDARDAIVHTLQACHGCVPDLALVLRGCQPPLPGAKPGVSERKMTPFWINSPDQVPEQERQRKQQGTKEFTFPMPYTSSMPTAHRGSLAPPRGPWPPYFPSLSSPSGTAWGPPTAFDLLKSIWLVATPPPPRPWGVGLPQPLPQPSSPLLPRTSVLDWSPSPPSPLPSLSWVVAQSSPEAWSFPPMRLY

SEQ ID NO: 14720 - protein, 356 aa, Homo sapiens; identical to SEQ ID NO: 14719

SEQ ID NO: 14721 - protein, 221 aa, Homo sapiens
MEEPRPSKRLRSMAPNQASGGPPPEPGCCVADPEGSVEADGPAQPAQPAKPIAYVKPFRRQPPARPESPPPAERGRRRGGSRRPGRGRGRRAGPRGDAGQRQGAEGLMAPDVHIQLDHHGEPGHQGEPEITETAAFSLSETGPPPGTVQEGPGPDVAQPELGFQEPPAAPGPQAVDWQPVLTLYPCIGFRALGDSAVLQVIQTPQGTYVQGVPVFLTDIAY

SEQ ID NO: 14722 - protein, 221 aa, Homo sapiens; identical to SEQ ID NO: 14721

SEQ ID NO: 14723 - protein, 221 aa, Homo sapiens; identical to SEQ ID NO: 14721

SEQ ID NO: 14724 - protein, 221 aa, Homo sapiens; identical to SEQ ID NO: 14721

SEQ ID NO: 14725 - protein, 221 aa, Homo sapiens; identical to SEQ ID NO: 14721

SEQ ID NO: 14726 - protein, 221 aa, Homo sapiens; identical to SEQ ID NO: 14721

SEQ ID NO: 14727 - protein, 221 aa, Homo sapiens; identical to SEQ ID NO: 14721

SEQ ID NO: 14728 - protein, 221 aa, Homo sapiens; identical to SEQ ID NO: 14721

SEQ ID NO: 14729 - protein, 221 aa, Homo sapiens; identical to SEQ ID NO: 14721

SEQ ID NO: 14730 - protein, 389 aa, Homo sapiens
MHACSSTALHPRPFIHGFSFTTFLQQLFPHGSSTALHPWPFIHGSSPMALHPRLFTHGPSSTALHPCPFTHGSSPMSLHPRLFTHSPSSMPLHPRPFVHASSPTALRPCLFTHGPSSMPLHPRPFVHASSPTALPPCLFTHGPSSMPLHPRPFLHASSPTALPPCLFTHGPSSMPLHPRPFVHASSPTALRPCLFTHGPSSMPLHPRPFVHASSPTALPPCLFTHGPSSMPLHPRPFVHASSPTALRPCLFTHGPSSMPLHPRPFLHASSPTALRPCLFTHGPSSMPLHPRPFVHASSPTALRPCLFTHGPSSMPLHPRPFVHASSSTSLHPRPFIHASSSKSLHLRLFSHSSCLVGFSQQGNVLLLSARATFNTCLLVSNMYFLIISY

SEQ ID NO: 14731 - protein, 389 aa, Homo sapiens; identical to SEQ ID NO: 14730

SEQ ID NO: 14732 - protein, 422 aa, Homo sapiens
MQHPKPFCAPAAPQEGFSPQSLEGAEVLGNQPAPTCAEPPPAMGSLNLYHPPDPEKEVFPAPPAGFQMAPCGCFFDPRIYRIEWTTPDLGQSALYKLAASSGGPAGVPSAPGSYLLEPQPYLKAPGLPPYPHYQQAPGGPQFLLPYFPPEGPGPEALGFVGDAGPAAFVELPLPPLEEGPAPLPPPPPKENKPPPVLITLPAEPTLPPDAYSHLQGHLGHFPGPEPLAFPVKELQGSGARPGVPLYPPGLSELKVAEVKEGALLGAGKAKAPKTARALALPDKVLLEDAMKLFDCLPGASEPEGTLCEVPGPALPDSSGGNSADDIRSLCLPEELLSFDYSVPEILDTVSNVDYFFNFKALDEEQPPHPGPPATNTPAPILSGKRKASTAKKGKPGRKARQPAGPASATPPGPREDLGATPH

SEQ ID NO: 14733 - protein, 266 aa, Homo sapiens
MGSRPRSPSAFPAPWWGQQPGGPGPAKRLRLEEPAGPEPRVAPSLEDPAGTPAVGALTSIVVLAAGCALRVPLDDVDLVLELPPTSILRVSLDGHTLILIPEVLLSSVDERSGAQDDSSAGLEVDVFLGALREDVVVEQEVFCASVPEIAAQEEAYEEDADPEFPELQMDSAAGSAAGLYSSARSMFSPYREGPIPEPCALAPNPSSEGHSPGPFFDPEFRLLEPVPSSPLQPLPPSPRVGSPGPHAHPPLPKRPPCKARRRLFQE

SEQ ID NO: 14734 - protein, 265 aa, Homo sapiens
MVSRPRSPSAFPAPWWGQQPGGPGPAKRLRLEEPAGPEPRAAPSLEDPAGDPAVDALTSIVVLAAGCALRVPLDDVDLVLEPAPTSILRVSLGGHTLILIPEVLLSSVDERSGAQHDSSAGLEVDVFLGAVREDVVVELEFCASVPEIAAQEEAYEEDADPEFPELRMDSPTGSAAGLYPSSRSMFIPYREGPIPEPCALAPNPSSERRSPRPIFDLEFRLLEPVPSSPLQPLPPSPCVGSPGPHARSPLPERPPCKARRRLFQA

SEQ ID NO: 14735 - protein, 262 aa, Homo sapiens
MGSRPCSPSACLAPWWGQQPGGPGPAKRSRLEEPAGPESRAAPSPEDPAGTPAVDALTSMVVLDAGCALRVPLEDVDLVLELAPMSVLRVSLGGHTLIVIPEVLLSSVDECSGAQGDWSAGLEVDVFLGAHGEDVVVEQEVCASVPEIAAEEEAYEEDADSEFPELWMDSAAGSAAGLYPSARSMFSPYREGPIRGPCALAPNPSSERRSPRPIFDLEFHLLEPVPSSPLQPLPPSPSPGPHARPELPERPPCKVRRRLFQE

SEQ ID NO: 14736 - protein, 262 aa, Homo sapiens; identical to SEQ ID NO: 14735

SEQ ID NO: 14737 - protein, 142 aa, Homo sapiens
MRGTSCVGGGAESPGGAGLSEGPRGRWLRLAPVCAYFLCVSLAAVLLAVYYGLIWVPTRSPAAPAGPQPSAPSPPCAARPGVPPVPAPAAASLSCLLGVPGGPRPQLQLPLSRRRRYSDPDRRPSRQTPRETPEAAEGRRPG

SEQ ID NO: 14738 - protein, 402 aa, Homo sapiens
MARTDQKPPCRGGCWGQPGHPNTGGAAAHPTYHPMGHRPRTCILLRGDQTTGGQAPSREISLGPWAAGTHFLAISTTPWGRKTPACISELPTSSGTAQPLANAVCEVQTVPGPGLRPQGTPAMRAPSHKGTPPTPNPWGPEQPQNRHKHPKKGVTGGPSPPPPAASRYGQTPGREPRVQAPGLGPCGRPASGRLLSLHLEKGDGKGTRQRIPLTDAAVGGDRTDIPSAIAAGPARTPDRHGLPIPGSTPTPMVGSGRLGAPVGRSGGGASARSSRPSCANVLLRADASLGTVLSVLWTGQLSRGWALLPPGDAGRHLETSVISAGVAAGIWLVEPGEAAQDPATRRTAPPRRTASPEPPAPGAPLPACPGRIPGAARFGPRSCPLGSPAVLAVTTGWSHRSV

SEQ ID NO: 14739 - protein, 116 aa, Homo sapiens
MSFSEQQCKQPCVPPPCLPKTQEQCQAKAEEVCLPTCQHPCQDKCLVQAQEVCLSQCQESSQEKCPQQGQEPYLPPCQDQCPPQCAEPCQELFQTKCVEVCPQKVQEKCSSPGKGK

SEQ ID NO: 14740 - protein, 218 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFLGYVVGRSDSVSTRLSNCDPPPTYEEATGQVNLQRSETEPHLDPPPEYEDIVNSNSASAIPMVPVVTTIK

SEQ ID NO: 14741 - protein, 218 aa, Homo sapiens; identical to SEQ ID NO: 14740

SEQ ID NO: 14742 - protein, 218 aa, Homo sapiens; identical to SEQ ID NO: 14740

SEQ ID NO: 14743 - protein, 218 aa, Homo sapiens; identical to SEQ ID NO: 14740

SEQ ID NO: 14744 - protein, 82 aa, Homo sapiens
MDPGPKGHCHCGGHGHPPGHCGPPPGHGPGPCGPPPHHGPGPCGPPPGHGPGPCGPPPHHGPGPCGPPPGHGPGHPPPGPHH

SEQ ID NO: 14745 - protein, 81 aa, Homo sapiens
MDPGKGHCHCGGHGHPPGHCGPPPGHGPGPCGPPPHHGPGPCGPPPGHGPGPCGPPPHHGPGPCGPPPGHGPGHPPPGPHH

SEQ ID NO: 14746 - protein, 178 aa, Homo sapiens
  MOD_RES (1)..(1): Any amino acid
XRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 14747 - protein, 2229 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGLHEEVDYSEKLKFSDDEEEEEVVKDGRPKWNSWDPRRQRQLSMSSADSADAKRTREEGKDWAEAVGASRVVRKAPDPQPPPRKLHGWAPGPDYQKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQKSLPPRFQRQQQQQQQEQLYKMQHWQPVYPPPSHPQRTFYPHHPQMLGFDPRWMMMPSYMDPRITPTRTPVDFYPSALHPSGLMKPMMPQESLNGTGCRSEDQNCVPPLQERKVTPIDSPPVWSPEGYMALQSKGYPLPHPKSSDTLAMDMRVRNESSFSASLGRAGGVSAQRDLFEERGEEYLSAFDKKAQADFDSCISSQRIGQELLFPPQENVQDAGAPGGHTQNLRCSPLEPDFVPDEKKPECGSWDVSHQPETADTAHGVERETPREGTAFNISSWDKNGSPNKQPSSEPEWTPEPRSSSSQHPEQTGRTRRSGPIKKPVLKALKVEDKEKELEKIKQELGEESTRLAKEKEQSPTAEKDEDEENDASLANSSTTTLEDKGPGHATFGREATKFEEEEKPDKAWEARPPRESSDVPPMKRNNWIFIDEEQAFGVRGQARGRGRGFREFTFRGRPAGGNGSGLCGGGVLGARSIYCSSQRSGRGRGLREFARPEDCPRAKPRRRVASETHSEGSEYEELPKRRRQRGSENGNEGSLLEREESTLKKGDCRDSWRSNKGCSEDHSGLDAKSRGPRAFGRALPPRLSNCGYGRRTFVSKESPHWQSKSPGSSWQEYGPSDTCGSRRPTDRDYVPDSYRHPDAFGGRGFEDSRAEDKRSFFQDEHVADSENAENRPFRRRRPPRQDKPPRFRRLRQERESLGLWGPEEEPHLLAGQWPGRPKLCSGDKSGTVGRRSPELSYQNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 14748 - protein, 268 aa, Homo sapiens
MPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 14749 - protein, 1535 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGLHEEVDYSEKLKFSDDEEEEEVVKDGRPKWNSWDPRRQRQLSMSSADSADAKRTREEGKDWAEAVGASRVVRKAPDPQPPPRKLHGWAPGPDYQKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQKSLPPRFQRQQQQQQQEQLYKMQHWQPVYPPPSHPQRTFYPHHPQMLGFDPRWMMMPSYMDPRITPTRTPVDFYPSALHPSGLMKPMMPQESLNGTGCRSEDQNCVPPLQERKVTPIDSPPVWSPEGYMALQSKGYPLPHPKSSDTLAMDMRVRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 14750 - protein, 796 aa, Homo sapiens
MKPMMPQESLNGTGCRSEDQNCVPPLQERKVTPIDSPPVWSPEGYMALQSKGYPLPHPKSSDTLAMDMRVRNESSFSASLGRAGGVSAQRDLFEERGEEYLSAFDKKAQADFDSCISSQRIGQELLFPPQENVQDAGAPGGHTQNLRCSPLEPDFVPDEKKPECGSWDVSHQPETADTAHGVERETPREGTAFNISSWDKNGSPNKQPSSEPEWTPEPRSSSSQHPEQTGRTRRSGPIKKPVLKALKVEDKEKELEKIKQELGEESTRLAKEKEQSPTAEKDEDEENDASLANSSTTTLEDKGPGHATFGREATKFEEEEKPDKAWEARPPRESSDVPPMKRNNWIFIDEEQAFGVRGQARGRGRGFREFTFRGRPAGGNGSGLCGGGVLGARSIYCSSQRSGRGRGLREFARPEDCPRAKPRRRVASETHSEGSEYEELPKRRRQRGSENGNEGSLLEREESTLKKGDCRDSWRSNKGCSEDHSGLDAKSRGPRAFGRALPPRLSNCGYGRRTFVSKESPHWQSKSPGSSWQEYGPSDTCGSRRPTDRDYVPDSYRHPDAFGGRGFEDSRAEDKRSFFQDEHVADSENAENRPFRRRRPPRQDKPPRFRRLRQERESLGLWGPEEEPHLLAGQWPGRPKLCSGDKSGTVGRRSPELSYQNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPCPGAGSPCQC

SEQ ID NO: 14751 - protein, 178 aa, Homo sapiens
CEGRQAKVKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQKSLPPRFQRQQQQQQQE

SEQ ID NO: 14752 - protein, 588 aa, Homo sapiens
  MOD_RES (1)..(1): Any amino acid
XGRGFEDSRAEDKRSFFQDEHVADSENAENRPFRRRRPPRQDKPPRFRRLRQERESLGLWGPEEEPHLLAGQWPGRPKLCSGDKSGTVGRRSPELSYQNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLK

SEQ ID NO: 14753 - protein, 175 aa, Homo sapiens
ERKVTPIDSPPVWSPEGYMALQSKGYPLPHPKSSDTLAMDMRVRNESSFSASLGRAGGVSAQRDLFEERGEEYLSAFDKKAQADFDSCISSQRIGQELLFPPQENVQDAGAPGGHTQNLRCSPLEPDFVPDEKKPECGSWDVSHQPETADTAHGVERETPREGTAFNISSWDKNG

SEQ ID NO: 14754 - protein, 1535 aa, Homo sapiens; identical to SEQ ID NO: 14749

SEQ ID NO: 14755 - protein, 326 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDG

SEQ ID NO: 14756 - protein, 2817 aa, Homo sapiens
MSEKSGQSTKAKDGKKYATLSLFNTYKGKSLETQKTTARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 14757 - protein, 2898 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQILSQPNLVPPLVRAPHTNTFPAPVQRPPMALASQMPPPLTTGLMSHARLPHVARGPCGSLSGVRGNQAQAALKAEQDMKAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 14758 - protein, 2653 aa, Homo sapiens
VPNQMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKAEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQILSQPNLVPPLVRAPHTNTFPAPVQRPPMALASQMPPPLTTGLMSHARLPHVARGPCGSLSGVRGNQAQAALKAEQDMKAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 14759 - protein, 270 aa, Homo sapiens [sequence omitted]

SEQ ID NO: 14760 - protein, 2752 aa, Homo sapiens
MSEKSGQSTKAKDGKKYATLSLFNTYKGKSLETQKTTARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 14761 - protein, 2850 aa, Homo sapiens
MSEKSGQSTKAKDGKKYATLSLFNTYKGKSLETQKTTARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKAEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQILSQPNLVPPLVRAPHTNTFPAPVQRPPMALASQMPPPLTTGLMSHARLPHVARGPCGSLSGVRGNQAQAALKAEQDMKAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 14762 - protein, 763 aa, Homo sapiens
ILPPTQMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKAEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREE

SEQ ID NO: 14763 - protein, 309 aa, Homo sapiens
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 14764 - protein, 309 aa, Homo sapiens
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPPQGGNQSQGPPPRPGKPEGPPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 14765 - protein, 166 aa, Homo sapiens
MLLILLSVALLAFSSAQDLDEDVSQEDVPLVISDGGDSEQFIDEERQGPPLGGQQSQPSAGDGNQNDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 14766 - protein, 166 aa, Homo sapiens; identical to SEQ ID NO: 14765

SEQ ID NO: 14767 - protein, 166 aa, Homo sapiens; identical to SEQ ID NO: 14765

SEQ ID NO: 14768 - protein, 166 aa, Homo sapiens; identical to SEQ ID NO: 14765

SEQ ID NO: 14769 - protein, 161 aa, Homo sapiens
MFSLPLNCSPDHIRRGSCWGRPQDLKIAAPAWNSKCHPGAGAAMARCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDDDSDSADDATSN

SEQ ID NO: 14770 - protein, 128 aa, Homo sapiens
  MOD_RES (1)..(1): Any amino acid
XQHARTLWYDRPSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDDDSDSADDATSN

SEQ ID NO: 14771 - protein, 98 aa, Homo sapiens
MRKMNTLLLVSLSFLYLKEVMGLKCNTCIYTEGWKCMAGRGTCIAKENELCSTTAYFRGDKHMYSTHMCKYKCREEESSKRGLLRVTLCCDRNFCNVF

SEQ ID NO: 14772 - protein, 114 aa, Homo sapiens
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 14773 - protein, 103 aa, Homo sapiens
MGSRCAKLNTGQSPGHSPGHSTGHGRGHESSMKKLMACVSQDNFSLSSAGEEEEEEEEEGEEEEKEELPVQGKLLLLEPERQEEGHKDNAEAQQSPEPKRTPS

SEQ ID NO: 14774 - protein, 247 aa, Homo sapiens
MNLLLILTFVAAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 14775 - protein, 174 aa, Homo sapiens
MACGPGDLQSLTSPLSSARLDYQPSIEGPWLRACGQTNVSCRVVKGKLVEVGKWPWQVSILFLGTYICSGSLIHHQWVLTAAHCLQRFKDLSLYSVMVGVHQRPENSTQLPLTRMVIHKDFSNLMSQDIALLKLRDSISWSPFVQPVCLPNIKFKPSIGSMCWVIGWGTTGKKG

SEQ ID NO: 14776 - protein, 241 aa, Homo sapiens
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 14777 - protein, 260 aa, Homo sapiens
MTRHWPWEVSLRMENEHVCGGALIDPSWVVTAAHCIQGTKEYSVVLGTSKLQPMNFSRALWVPVRDIIMHPKYWGRAFIMGDVALVHLQTPVTFSEYVQPICLPEPNFNLKVGTQCWVTGWSQVKQRFSANSMLTPELQEAEVFIMDNKRCDRHYKKSFFPPVVPLVLGDMICATNYGENLCYGDSGGPLACEVEGRWILAGVLSWEKACVKAQNPGVYTRITKYTKWIKKQMSNGAFSGPCASACLLFLCWLLQPQMGS

SEQ ID NO: 14778 - protein, 228 aa, Homo sapiens
MTRHWPWEVSLRMENEHVCGGALIDPSWVVTAAHCIQGTKEYSVVLGTSKLQPMNFSRALWVPVRDIIMHPKYWGRAFIMGDVALVHLQTPVTFSSTANSMLTPELQEAEVFIMDNKRCDRHYKKSFFPPVVPLVLGDMICATNYGENLCYGDSGGPLACEVEGRWILAGVLSWEKACVKAQNPGVYTRITKYTKWIKKQMSNGAFSGPCASACLLFLCWLLQPQMGS

SEQ ID NO: 14779 - protein, 392 aa, Homo sapiens
MAAPLRIQSDWAQALRKDEGEAWLSCHPPGKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 14780 - protein, 375 aa, Homo sapiens
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 14781 - protein, 237 aa, Homo sapiens
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKML

SEQ ID NO: 14782 - protein, 375 aa, Homo sapiens; identical to SEQ ID NO: 14780

SEQ ID NO: 14783 - protein, 247 aa, Homo sapiens
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQ

SEQ ID NO: 14784 - protein, 375 aa, Homo sapiens; identical to SEQ ID NO: 14780

SEQ ID NO: 14785 - protein, 521 aa, Homo sapiens
MKQEGSARRRGADKAKPPPEDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 14786 - protein, 115 aa, Homo sapiens
LTSPRSCSWIAPKMQSSLLAQAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 14787 - protein, 356 aa, Homo sapiens
MDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKGW

SEQ ID NO: 14788 - protein, 122 aa, Homo sapiens
MEDTPLVISKQKTEVVCGVPTQVVCTAFSSHILVVVTQFGKMGTLVSLEPSSVASDVSKPVLTTKVLLGQDEPLIHVFAKNLVAFVSQEAGNRAVLLAVAVKDKSMEGLKALREVIRVCQVW

SEQ ID NO: 14789 - protein, 122 aa, Homo sapiens; identical to SEQ ID NO: 14788

SEQ ID NO: 14790 - protein, 122 aa, Homo sapiens; identical to SEQ ID NO: 14788

SEQ ID NO: 14791 - protein, 162 aa, Homo sapiens
MEGLVVAAGGDVSLHNFSARLWEQLVHFHVMRLTDSLFLWVGATPHLRNLAVAMCSRYDSIPVSTSLLGDTSDTTSTGLAQRLGLGGKTGLACECGVEWGLSKGHEAECSTLPTPQHTSCGPARKTNKQVFVSYNLQNTDSNFALLVENRIKEEMEAFPEKF

SEQ ID NO: 14792 - protein, 123 aa, Homo sapiens
MEGLVVAAGGDVSLHNFSARLWEQLVHFHVMRLTDSLFLWVGATPHLRNLAVAMCSRYDSIPVSTSLLGDTSDTTSTGLAQRLARKTNKQVFVSYNLQNTDSNFALLVENRIKEEMEAFPEKF

SEQ ID NO: 14793 - protein, 104 aa, Homo sapiens
MEGLVVAAGGDVSLHNFSARLWEQLVHFHVMRLTDSLFLWVGATPHLRNLAVAMCSRYDSIPVSTSLLGDTSDTTSTGLAQRLGMYPQLALHGQPGGAHSLMEP

SEQ ID NO: 14794 - protein, 212 aa, Homo sapiens
MASRYDRAITVFSPDGHLFQVEYAQEAVKKGSTAVGIRGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 14795 - protein, 250 aa, Homo sapiens
MASRYDRAITVFSPDGHLFQVEYAQEAVKKGSTAVGIRGTNIVVLGVEKKSVAKLQDERTVRKICALDDHVCMAFAGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 14796 - protein, 212 aa, Homo sapiens
MASRYDRAITVFSPDGHLFQVEYAQEAVKKGSTAVIFIGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 14797 - protein, 211 aa, Homo sapiens
MDVCTFEKVGIRGTNIVVLGVEKKSVAKLQDERTVRKICALDDHVCMAFAGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKE

SEQ ID NO: 14798 - protein, 543 aa, Homo sapiens
MNCLEGPGKTCGPLASEEELVSACQLEKEEENEGEEEEEEEDEEDLDPDLDPDLEEEENDLGDPAVLGAVHNTQRALLSSPGVKAPGMLGMSLASLHFLWQTLDYLSPIPFWPTFPSTSSPAQHFGPRLPSPDPTLFCSLLTSWPPRFSHLTQLHPRHQRILQQQQHSQTPSPPAKKPWSQQPDPYANLMTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 14799 - protein, 543 aa, Homo sapiens; identical to SEQ ID NO: 14798

SEQ ID NO: 14800 - protein, 2235 aa, Homo sapiens
MPLFFSALLVLLLVALSALFLGRWLVVRLATKWCQRKLQAELKIGSFRFFWIQNVSLKFQQHQQTVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 14801 - protein, 138 aa, Homo sapiens
MEAWESSQPLLRCEIPCPLPGTDRDGSVSLPGEAASCDLDTLEPEHGNRRVSGNPISVCWAYKVTKVKCWSVRERGGRHIGGPRNTLKHPAHHGMGKNLATSLPTAASLGLGKGQLLVSIRFMDTTKKRGQSETFNIC

SEQ ID NO: 14802 - protein, 400 aa, Homo sapiens
MGVLMSKRQTVEQVQKVSLAVSAFKDGLRDRPSIRRTGELPGSRRGTVEGSVQEVQEEKEAEAGTSVVQEESSAGRAAWERLRDGRGVEPEEFDRTSRFTPPAFIRPTRKLDDDKPPEICLEPREPVVNDEMCDVCEVWTAESLFPCRVCTRVFHDGCLRRMGYIQGDSAAEVTEMAHTETGWSCHYCDNINLLLTEEEMYSLTETFQRCKVIPDCSLTLEDFLRYRHQAAKRGDRDRALSEEQEEQAARQFAALDPEHRGHIEWPDFLSHESLLLLQQLRPQNSLLRLLTVKERERARAAFLARGSGSTVSEAECRRAQHSWFCKRFPEAPSCSVSISHVGPIADSSPASSSSKSQDKTLLPTEQESRFVDWPTFLQENVLYILAARPNSAAIHLKPPG

SEQ ID NO: 14803 - protein, 409 aa, Homo sapiens
MGSQAAAEWRNWASWEVSSSLSGCSMGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 14804 - protein, 110 aa, Homo sapiens
GARSPGSTHQGSLASGVLPIKCSHVEFGMWKGGRSHPFLPHSSRCAGSGGQLDSILPHQSPAWGPWGCKDLSSGFPSFLTSSILWKSAVVREPHISPHQAPPYKTSDCIM

SEQ ID NO: 14805 - protein, 1250 aa, Homo sapiens
MAAMAPGGSGSGGGVNPFLSDSDEDDDEVAATEERRAVLRLGAGSGLDPGSAGSLSPQDPVALGSSARPGLPGEASAAAVALGGTGETPARLSIDAIAAQLLRDQYLLTALELHTELLESGRELPRLRDYFSNPGNFERQSGTPPGMGAPGVPGAAGVGGAGGREPSTASGGGQLNRAGSISTLDSLDFARYSDDGNRETDEKVAVLEFELRKAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQIKEYLHIHNEISWEWDPSLNTKCVSYTHYTHSLKEEDRKLLVGFLEDVMTLLSLSHAPLDSLKASFVELGANPAYHELLLTVLWYGVVHTSALVRCTAARMFELLVKGVNETLVAQRVVPALITLSSDPEISVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 14806 - protein, 2017 aa, Homo sapiens
MTSRTKRRQKVKISISKINHSSYRKEHRPFWEHQPPPHQNWAVGGRCGAGARPGLSQRRGREVRREAQGGASSRRLRARLYFSESTSLPLDRRGSPGPLGPAPHGLRRAAPRGPARRTPRSTALTSRRRAQRPRHGDRLRLRSEARPRAAGDWPCARGGAVRPGRPHRPPRVESARGAHAGRAATDQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYGYVLNESQSRQNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 14807 - protein, 1618 aa, Homo sapiens
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRALDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 14808 - protein, 1117 aa, Homo sapiens
MLAGRPGTRSAVGELGTESSDNLDRAPLGPRESGGHHRPGSYLDMKIHLEKNLEEERQILLQQQKICRNRARKYFVESNRRKKAFEEKRKEQEEKEHQIREQILQQRKQKFEEVTEKFQRAHVPLSQRRKAVSRKPVPPLEEALKQIQESNLKSEVNLPFSRRPTINWRAIDSALPSALSKNDHKHQKQLLSKINCEKEMNENMRATLATSKNVFQLKLEETQKLLEDQHLSNLQKFGDEVNQITNSETLSSIDSLEATEHEEIYLTLNKEHSTSIQRNTISLKPANMQSTNLSCFDEDKLAFSKTQHINNWLTNLDASNTQNVTAFSDILSKSNVLPSWEYFNSKEQNPSPLNGTVERATNTANNSVPFVSSPPMFVLDKKCEKTSETSTMRTTDSTSGAFKRERPLVTESPTFKFSKSQSTSDSLTQEVATFPDQEKYSELNQENGTTSIPTSCVPVATPLVLPSNIQSARPSAKNSIHIKEIDAVQCSDKLDELKDGKEEEIKYFNCNKEELPLFSDSFQDAYIPHNPDSKDEKQKLAETSSLSNVTSNYDFVGQHKKMKYNIHERNGVRFLKSILKKESKYEHGYLKALIINQSFKFGNQKAAAIRDSIELTKEKGAEIPKTIKKLRWFDETSNIENNAENSHSLKNKTGTTQQHSQQFHIQSGAGSNIISVSTCAVNSADTKKSREDSISENVTTLGGSGADHMPLNCFIPSGYNFAKHAWPASKKEESKIPVHDDSKTKQGKPQRGRAKIIRKPGSAKVQSGFICTNRKGAVIQPQSASKVNIFTQAQGKLIIPCPPPQSTSNIRSGKNIQVSQCQPVTPENPQNIITHNSFNSKHVLPTEHSLNQWNQESSSPLSNACSDLVTVIPSLPSYCSSECQTFAKINHSNGTQAVARQDATLYCTQRSPVCEESYPSVTLRTAEEESVPLWKRGPNVLHQNKRATGSTVMRRKRIAETKRRNILEQKRQNPGSVGQKYSEQINNFGQSVLLSSSEPKQTTRGTSYIEEVSDSTSEFLMAENLVKASVPEDEILTVLNSKQIQKSNLPLNKTQQFNICTLSAEEQKILESLNDLSERLHYIQESICKNPSIKNTLQIIPLLEKREDRTSSCRDKR

SEQ ID NO: 14809 - protein, 856 aa, Homo sapiens
MGTTASTAQQTVSAGTPFEGLQGSGTMDSRHSVSIHSFQSTSLHNSKAKSIIPNKVAPVVITYNCKEEFQIHDELLKAHYTLGRLSDNTPEHYLVQGRYFLVRDVTEKMDVLGTVGSCGAPNFRQVQGGLTVFGMGQPSLSGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVDRAITACAELHDLKEVVLENQKKLEGIRPESPAQGSGSRHSVWQRALWSLERYFYLILFNYYLHEQYPLAFALSFSRWLCAHPELYRLPVTLSSAGPVAPRDLIARGSLREDDLVSPDALSTVREMDVANFRRVPRMPIYGTAQPSAKALGSILAYLTDAKRRLRKVVWVSLREEAVLECDGHTYSLRWPGPPVAPDQLETLEAQLKAHLSEPPPGKEGPLTYRFQTCLTMQEVFSQHRRACPGLTYHRIPMPDFCAPREEDFDQLLEALRAALSKDPGTGFVFSCLSGQGRTTTAMVVAVLAFWHIQGFPEVGEEELVSVPDAKFTKGEFQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 14810 - protein, 409 aa, Homo sapiens
MSLHAWEWEEDPASIEPISSITSFYQSTSECDVEEHLKAKARAQESDSDRPCSSIESSSEPASTFSSDVPHVVPCKFTISLAFPVNMGQKGKYASLIEKYKKHPKTDSSVTKMRRFYHIEYFLLPDDEEPKKVDILLFPMVAKVFLESGVKTVKPWHEGDKAWVSWEQTFNITVTKELLKKINFHKITLRLWNTKDKMSRKVRYYRLKTAGFTDDVGAFHKSEVRHLVLNQRKLSEQGIENTNIVREESNQEHPPGKQEKTEKHPKSLQGSHQAEPETSSKNSEEYEKSLKMDDSSTIQWSVSRTPTISLAGASMMEIKELIESESLSSLTNILDRQRSQIKGKDSEGRRKIQRRHKKPLAEEEADPTLTGPRKQSAFSIQLAVMPLLAGTHCLPCSQQLLLVLWPERP

SEQ ID NO: 14811 - protein, 1200 aa, Homo sapiens
MDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQVEVLTSLKALSHHVDPSQLPAVLEGPFPYCHTEWVHFFQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAAQYRRGLELSKQAAQLGATARGAGEAERAEFPELAAFASTQRAFQAELTHFYMAAERQRTDLETLLHLHRFCKRMTWFHMDCQDLMAQLRLDKTSRVSPGDQRRLHRYLQRLASEFPAEKLAAVGLQVASLSRAGLGQELWEEARIRHEEIRMLLEKALTHSSCPEAPAAHSARPERRGVAAKGQGVSVEVTSKGRWDQPPLDSLGMDHLPKSYWPPGPPRGEQNRTFQAGSPPQEAGQAAEAEDGKGSHKLPDPAREHLLATTFFRQQPPRQSQVPRLTGGSFSSEGTDSQTSLEDSPQTSPLASL

SEQ ID NO: 14812 - protein, 577 aa, Homo sapiens
MADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHGTFRLSPLKSTRKKMGMHRTPEELEENQILEDIFFI

SEQ ID NO: 14813 - protein, 471 aa, Homo sapiens
MVLDSGAQAYDQAPPSPPTSPPSLRHRLKPSDRDGPPLYPWSQSLALPLALAVPPALQPQPEQQPFSQMLLGHRGHMRRSESTYSVNSTGRRGRGTLGRPPPGRGRNPGGGTLRPAASLPHIAKTQRDAGHIASKSPCMLVALRPTNMDRERDKFFQSHYTYNPQFEYQEPMPTAVLEKYCEASGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGCFSKDQVYLDGIVRILRHRQTIDFPLLTSLGKVSYEDVDHLRPHGVLDNTRVPHFMQDLARYRQQLEHIMATNRLDEAELGRLLPD

SEQ ID NO: 14814 - protein, 143 aa, Homo sapiens
MVVFVGRRLPALLGLFKKKGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKDSQKELA

SEQ ID NO: 14815 - protein, 707 aa, Homo sapiens
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKETDKLRPRDGTVSKSNRKSGLSSVLLMTVLLC

SEQ ID NO: 14816 - protein, 936 aa, Homo sapiens
MLLAPQGRSFSKKRMGLNRWKRFTRKPSPKPTFGPDSVEHWIKRVEKASEFAVSNAFFTRNSDLPRSPWGQITDLKTSEQIEDHDEIYAEAQELVNDWLDTKLKQELASEEEGDAKNTVSSVTIMPEANGHLKYDKFDDLCGYLEEEEESTTVQKFIDHLLHKNVVDSAMMEDLGRKENQDKKQQKDPRLTMEMRHKQVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRKQQLATEYNRKQVLRHCFTEWQHWHGAELLKRELALTKEETRKKMDALLQAASLGKLSANGLSGISLPEEATAMVGPPVKNGQETAVPPLWEKPPLGSSGCMLSPPLGRTTTGNLQGSLQNVSLSAPGNKQHKTLGAEPSQQPGSNETLRTTSQKAEPLCLGHFHNRHVFQQQLIEKQKKKLQEQQKTILELKKNLQLAEAQWAAEHALAVTEAQSHLLSKPREEEPRTCQMLVNSPVASPGTEGRSDSRNSLSGLRRKPKQLMTPHPILKAMEERAIQRAECRRILAEKKKKQEEEKLAQLKAQEEERQKREAEEKEAQLERKREEKRLKKMKELEKQKRIKRNQQLEAIAKEHYERVLLRKKGLEPWKRLRMQSKQNIQVAEEHYSLFLQRKYMLTWFQRSQESLARKMAQADQFYSQILLKRVIQSWLQYVIDLQEEVRKFCVHFLQKKIFRAWFNMVREVKIDSQGKHEIAAEHSDRRILWITLRTWKKFVKFMKEERVKEERRQQLRRKVVEILPDFQVPGRYHELYQQSDTWSLSKTSLVNE

SEQ ID NO: 14817 - protein, 154 aa, Homo sapiens
MSKRNQVSYVRPAEPAFLARFKERVGYREGPTVETKRIQPQPPDEDGDHSDKEDEQPQVVVLKKGDLSVEEVMKIKAEIKAAKADEEPTPADGRIIYRKPVKHPSDEKYSGLTASSKKKKPNEDEVNQDSVKKNSQKQIKNSSLLSFDNEDENE

SEQ ID NO: 14818 - protein, 164 aa, Homo sapiens
MDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKTFHSCPRPSGSRGGTEPSPRPCGSQDALL

SEQ ID NO: 14819 - protein, 2266 aa, Homo sapiens
MMPGETHSAAPGTAADLSRCQGCASLQQNLNEYVEALITLKQKIINTDNLLTEYQKKCDELQFARRENSNLHHQVEEMLQKISPLQKCQEELGSLKAELEEKKSSLKLYQDTHQEYARVKEECLKSDAQKKKLEAKVKKLQEAAVKQTQDFKQLRNEKKILEKEFKKTQERLDEFSKQKNEKELRHIGTQISSDSYGSIDKRKVKLLLKELWLCVNTTHRLPGEGSRCVPEKPAKAITSSRVPGEDGTLPPTQGSPLRTSNVQTCLTKLSMEIKEDFLCQNVEKQSSSGTNCSSDHVFNENGNLEVLVQSHRDGGSTEFVDHDHFFDEDLQAAIDFFKLPPPLLSPVPSPPPMSSPHPGSLPSSFAPETYFGEYTDSSDNDSVQLRNSAECVSEDDTTESQNYFGSLRKNKGSGTWEEKPKSHEAIQALNTWEVNKVTTSGLETFTATLRESSATHSLVGEKHWTTASRSMSDRKRDILHETKTQMEVREMDKSVQTEKTIHKLTRGLCIERLSASPAQEKEAAPGKSELCSSPLGKRPLNELMESEGKTVLSKMMGSPKSEFTKWTRINEITSEPDRITVSGHFHRLSRELEKEKEDTQGFTLGESPESEDDDSGDGMDVAGLDIETSFSSSSTLVALSVGSNPQSSSGLDCGNDTDITTKVFSTEPHHSEHKLQTKTLNTLHLQSEPPECSIGGNNLENSLCALSPELGASNFNDQKSSGIEYTKVVKGLTKIHSLPRSVFMKATKDGQCESQDPRIELTLNKPDFTSLIGSQAALIKSGLGFVKSTSWHHSDLLRKGGEESLRAKSEHEQKTSHQLQKAMPFLQNRGPTPKPDLLRENNNPVEFKTTASVLPNQVSVITKQTRPEKVQSAKLEHLRPHRVEPTLVTENSGNKTGMSTVAKCDGERDDTTQNITEVAAVKSISPEVSASRRKLDFNSPGGSSPVENSDCSTNSRLSFSPENILIQNQDIVREAAVQGDGQKQRQPQATDLDSSGTHGSEMLPATEVTVSGGFSVEETSCGDTGRSGGEALAVANDSTSTPQNANGLWKLKSTTPGGALPECFGTTDTTFSSAFCRKHGETQDTSQSSLPGTLHCYTGIREGGDDTEVESEAFSCSEGSEQQDAPDDSQKNLGDTDAAVAEVRPSLEVGYLTSALQDFNISTFSELDRLSTSEVVMFLESCQLGDYSSGDSVSECSSKGTLSKEMNKELKASEIGEKYRKQPCEEETLGTCEEWIESEEDDYSLKNTSQLTQCSLETLSEVLTKIRQELQTNSEDCNGKDTGSLLLLNVNNNMTTENLKEKSPFRETTGSSSHASEPTPQAAALDTEGSSPISGMPQNENPQSRPEARSDAGRQTDGGEEDLPEPVEPSALCSDSVMEPSIEQSSNCEAETTFQCQIATVTSEVINVLINKDQNLVIEKGDNWTIISGVAVLPHVDQVTLCDIPGDIPISQDQGELEAGCIPVTSAEKSPEASHTGPAFQEAPCGNNLSCPQEDVSSSGQSTNFDKSRLRNRPVKPSIWISSQIYDQNFETQIVASDHTYYNSKLEPSGKNKNRSKISNKDQSNKPVKTSASSRVETHQSEVAQSFSGEKANTKTQRSQTQTILANADTSTPTDCSPDTLSKIRQEVGPPLPPLLAPLIATPPRTSQPLSPLISSSSPSSPASPVGQVSPFRETPVPPAMSPWPEDPRRASPPDPSPSPSAASASERVVPSPLQFCAATPKHALPVPGRLPPCASGHAAVGGPQENSVKILDTMYPELSARARTLNILKGNIQLTRGPPADCKNLPGPASAMIGFKTITSAATAFVKTGSSSGGDCNQDKSRDLGTQQDSSGKRTLSTSTLRSAKRLRLDTGSPEPETRGVTAEGIHKNLPGNLPPAEVATTNEERSCSSPAVSAVSQLPLSPKETVESHDKAIANALKKIAEFSFDLLPVIRSHVYVGNISKKPVMRDQEKEVVYEFSTTKKHLAECLLHSILSELKIQKISMDHNYIHALCRVYVGICRQLGDLERARLFCYSLLKEDFPESEKLTLFIANMWHDIFLSQSVINKAMQLVARQRAKGEVLNCLRAFLNWEKNAPVDVGFMVSKLLLTIQLCPKTEFQPSEKFGEDLSDNTWEYIFAIDLLCCHQKWIWTHDNIISKELWPVMDKWIKYRKGHANIAYTPDIIIASILRLIGRLGQLGLKEGFPSAVKNISSVIGMFIQHAHDEDIPWGIQLAAVYALCDLSPSNPAEISKILEAWRREASKSVPSAIVSCLEEVSALSTEELG

SEQ ID NO: 14820 - protein, 453 aa, Homo sapiens
MDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSADHPPKLYHSALNRQKEQQRIERENLTISLCHPGWSAVT

SEQ ID NO: 14821 - protein, 113 aa, Homo sapiens
EERAEYTADIISTTVAEPYRTCFTAGGSKTSPVEQQPEQQQPQDIVSLPLPPLPHATPDPFTLYSHRTESAGGHLFLPQDLRWKSPGLGVFAVQSVYELARRHNVSPFYSGPP

SEQ ID NO: 14822 - protein, 520 aa, Homo sapiens
MAGCTRKLTHLRKRIHRPRRRTTRRWKRWFKFRKRKGEKRPRPNHKAVARRAKLKFSTSEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 14823 - protein, 915 aa, Homo sapiens
MPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 14824 - protein, 305 aa, Homo sapiens
MASRQPEVPALEASAPLGKMSLPIGIYRRAVSYDDTLEDPAPMTPPPSDMGSVPWKPVIPERKYQHLAKVEEGEASLPSPAMTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 14825 - protein, 1070 aa, Homo sapiens
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEVLGRCFLTVVQVHFQFLTHALQKVQPVAHSCFAEVIVPEKKNSGSGGGLSGMGHTPEVEEAVRSWRGAAEATSRLRERGCDGCLAGIEVQQLFCSQSAAIPEHQLKELNIKIDSALQAYKIALESLGHCEYAMKAGFHLNPKAIEASLQGCCSEAEAQQTGRRQTPPQPMQCELPTVPVQIGSHFLKGVSFNESAADNLKLKTHTMLQLMKEAGCYNGITSRDDFPVTEVLNQVCPSTWRGACKTAVQLLFGQAGLVVVDTAQIENKEAYAPQISLEGSRIVVQVPSTWCLKEDPATMSLLQRSLDPEKTLGLVDVLYTAVLDLNRWRAGREQALPCIQIQLQREICDFGNQADLPSGNGNKSSGGLQKTFSKLTSRFTKKASCTSSSSSTNYSIQNTPSKNIFIAGCSEEKAKMPGNIDTRLQSILNIGNFPRTTDPSQSAQNSSNTVANGFLMERRENFLHGDDGKDEKGMNLPTDQEMQEVIDFLSGFNMGQSHQGSPLVTRHNSAATAMVTEQKAGAMQPQQPSLPVPPPPRAPQAGAHTPLTPQPGLAPQQQSPKQQQPQVQYYQHLLQPIGPQQPPPQPRAPGKWVHGSSQQPAQAVGAGLSPLGQWPGISDLSSDLYSLGLVSSYMDNVMSEVLGQKPQGPRNNTWPNRDQSDGVFGMLGEILPFDPAVGSDPEFARYVAGVSQAMQQKRQAQHGRRPGNPRGNWPPMDDAHRTWPFPEFFTEGDGLHGGWSGAQGDSASSSDETSSANGDSLFSMFSGPDLVAAVKQRRKHSSGEQDTSTLPSPPLLTTVEDVNQDNKTKTWPPKAPWQHPSPLPSTLPSPSAPLYAVTSPGSQWNDTMQMLQSPVWAATNDCSAAAFSYVQTPPQPPPPPAHKAAPKGFKAFPGKGERRPAYLPQY

SEQ ID NO: 14826 - protein, 1395 aa, Homo sapiens
MYPICTVVVDGLPSESSSSSYPGPVSVSEMSLLHALGPVQTWLGQELEKCGIDAMIYTRYVLSLLLHDSYDYDLQEQENDIFLGWEKGAYKKWGKSKKKCSDLTLEEMKKQAAVQCLRSASDESSGIETLVEELCSRLKDLQSKQEEKIHKKLEGSPSPEAELSPPAKDQVEMYYEAFPPLSEKPVCLQEIMTVWNKSKVCSYSSSSSSSTAPPASTDTSSPKDCNSESEVTKERSSEVPTTVHEKTQSKSKNEKENKFSNGTIEEKPALYKKQIRHKPEGKIRPRSWSSGSSEAGSSSSGNQGELKASMKYVKVRHKAREIRNKKGRNGQSRLSLKHGEKAERNIHTGSSSSSSSGSVKQLCKRGKRPLKEIGRKDPGSTEGKDLYMENRKDTEYKEEPLWYTEPIAEYFVPLSRKSKLETTYRNRQDTSDLTSEAVEELSESVHGLCISNNNLHKTYLAAGTFIDGHFVEMPAVINEDIDLTGTSLCSLPEDNKYLDDIHLSELTHFYEVDIDQSMLDPGASETMQGESRILNMIRQKSKENTDFEAECCIVLDGMELQGERAIWTDSTSSVGAEGLFLQDLGNLAQFWECCSSSSGDADGESFGGDSPVRLSPILDSTVLNSHLLAGNQELFSDINEGSGINSCFSVFEVQCSNSVLPFSFETLNLGNENTDSSANMLGKTQSRLLIWTKNSAFEENEHCSNLSTRTCSPWSHSEETRSDNETLNIQFEESTQFNAEDINYVVPRVSSNYVDEELLDFLQDETCQQNSRTLGEIPTLVFKKTSKLESVCGIQLEQKTENKNFETTQVCNESPHGDGYSSGVIKDIWTKMADTNSVATVEIERTDAELFSADVNNYCCCLDAEAELETLQEPDKAVRRSEYHLWEGQKESLEKRAFASSELSNVDGGDYTTPSKPWDVAQDKENTFILGGVYGELKTFNSDGEWAVVPPSHTKGSLLQCAASDVVTIAGTDVFMTPGNSFAPGHRQLWKPFVSFEQNDQPKSGENGLNKGFSFIFHEDLLGACGNFQVEDPGLEYSFSSFDLSNPFSQVLHVECSFEPEGIASFSPSFKPKSILCSDSDSEVFHPRICGVDRTQYRAIRISPRTHFRPISASELSPGGGSESEFESEKDEANIPIPSQVDIFEDPQADLKPLEEDAEKEGHYYGKSELESGKFLPRLKKSGMEKSAQTSLDSQEESTGILSVGKQNQCLECSMNESLEIDLESSEANCKIMAQCEEEINNFCGCKAGCQFPAYEDNPVSSGQLEEFPVLNTDIQGMNRSQEKQTWWEKALYSPLFPASECEECYTNAKGESGLEEYPDAKETPSNEERLLDFNRVSSVYEARCTGERDSGAKSDGFRGKMCSSASSTSEETGSEGGGEWVGPSEEELFSRTHL

SEQ ID NO: 14827 - protein, 1742 aa, Homo sapiens
MWPAGAGTKLPCPRDSALRRAAFSGNLTALPSHLVPAGRSVRVFISANPEDTGAERQALRENVYPKLREFCRENYGLEFQVIDLYWGVEEDEWDSPELQKTRMKLLENCLKTSAGPCFVGLLGEKYGNIRIPGEVEASEFEMILDAAIEAKLETKLLEEWYCRDENSVPAAYYLRPKSEMLRSNRNAMQPSTNAENEKTWQEISDEIKKIFKAAVKLLHEKGKMKHSQAKRYLFSAIEDEFDFALGKQTPAFLKKCVCYIRKIANIERFVKIPEMGKYMDITGTEPRIIRDPEAQEKLIKLRDEFIPTIVASSNLRVYTSVTHCDMKLGYSQEIENHYIEGLGKQFYEDMIDIIQATIQQNFDTETDTLYDEILQHSSLCKTYASFYEYKCESLNIVHNYILPSKAGHINPLIIYGGPCTGKTLLLAEVAKKAYGWLHEDTGPESDPVVIVRFLGTTDMSSDLRTLLLSVCEQLAVNYRCLVQSYPKKIHDLCDLFINLLNESSLQRPLVIIFDALEQLSENDDARKLWWLPAHLPRFVRIVLSTLPNKHGILQKLRCLIHEEDNYIELIPRDRKMCSQVLKHQLLRVKRKVTSGQQIYVNNALSKCTLPMFVNLTFREVRHWRSHKDVDESSLSVTVHESIEQLFWSLEKKCGQKLVSRALGYITMAKMGLSEMELEDVLALDNSVMSELKENTRPSNPLRVPYLYIARLKEGLSGYLIERHVKNVTLLVWANRHLQLIAQKLYLQDDNDLREMHTILADYFLGVWSGGRRKAFCLEDPYLNGCLDLENRSLLEEEKHFMEQASFDRQAPDQPWVFQCNPLEPDIFFVNHRKMSELLYHLTRCGKTDDLLYGIIMNFSWLYTMIKIGQFDKVLSDIELAYNYSQEKELKFLANTLRSIKNKVTAFPGSLSAELQQRLLPVVSSLPKLRHLLLECDKDGPKYCSIVPLHSSMDVTYSPERLPLSSSHLHVTEILPTCNPSTVLTALENGSISTWDVETRQLLRQITTAQSVILGMKLTSDEKYLVVATTNNTLLIYDNVNSCLLSEVEIKGTKHGSSATYINGFTLSANHALAWLEASKDVTVIDLLYGWPLYQFHCWYEVTCVQCSLDGLYAFCGQYLNTTTIFHLGSGEKLCTVTSEFSGGFVKFLLILDTAQEMVMVDSEGSLSVWNTEDISSPQLTDDFDCRREDSEVVSIELSEDQSAVLICKALSIELLDTGLWKVAEKFRAKHNERFISAVLSKNGDCIIATMENTSAVFFWRRDTGQCMASLQEISGSIVKLVKSSHHNMLLSLSTSGVLSIWDIDIITAMSNIDKTGKPIQSLLLPARGEIIYSLDGSDCVHKWNFSSGFIEAVFKHEGIVEHCVLTSTGDIMVTSDDKSSQYVWHTSSGENLFRINGQRISQLLITHNDQFVVSLCEENASRVWRLATGHRVCNILTTLQNAFITSANTFVVGMTKSKVLAVSLWTGSITKKFCCEDGTTIVNFKLIPDCPDIIVFITSAETVNIWSLTDEVICRRVQLPNNFLKNLEDFEISPNGKLGIIARGDENINVLDLYSGKLRVVHASGIIWRQRLSRDGRYLVYICFRNGEEEDENGAIFSLIVMRLADGKNIGACSLYKTPTFLALSQRHLNIIVGFDDGSIGIYTVVDRVDAALKIKIATSNSRQIFNNATHTSRPKCNSYCFKISVDCLWRESTEVFARDSPITVSDSTESNEATPSKKHNSCYERVCSALEARGHSYAPDN

SEQ ID NO: 14828 - protein, 115 aa, Homo sapiens
VSGGVRLPASERRFLSCCPLPARPLLQRLASRHPASLPCSQQLLWRSSRAPPLLPSLPLGVLITDPLTRHPGHHHPAPFHSAALLVPVKPPTAWEGKSRLARPCLSQALEACQLT

SEQ ID NO: 14829 - protein, 194 aa, Homo sapiens
MAAKSTQDSLPRDTGEPSALPVQGRAEGRSSEGRKERTAECALRGKQASEPALRKRNFLPGPNSDTVRPAAETELVPCSLRHPRQDLCGEHPSFPVMQPSLETQAKPERDRAVLIPPKGPWPPAQGLAMRTHCPTGPPSKAYCRGGSSSTSRNQVASLAYRTQNTAASQPRQPGGRGKEDTAGYGSCSPRSLAV

SEQ ID NO: 14830 - protein, 938 aa, Homo sapiens
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLQDLLKNEQNQEEMTLDLLWDLSCHSSVSFPSTLSGTSFHFLSRTSLHSVEDNSSMDVKSMWDDIRLHLRRFLVSKLQSHNEINNSQQKILLKKQCLQQLLFLYPESEVIIKYQNIQNKLLANLLWNCFPSYNRDSNLDVIAHGYQSTMLKLYSVIKEDFNTLCEILAPSSMVKFIKETYLDTVTEEMAKFLENFCELQFRENAVRVVKTSKSSSKHRGAVHALVTTECPQKGRNFSLPLDKVEFLSQLIKSFMKLEKGVQELFDEILLSLKITRDTSGILEKSDREVVMEKPRANETNIPSEQSLPGKEATLLDFGWRSAFKEVSLPMAHCVVTAIEGFSTKILQQEQNERSSAVSYAMNLVNVQQVWQDSHMFPEEEQPKKIGKFCSDIMEKLDTMLPLALACRDDSFQEIRANLVEACCKVATAVLQRLQERAKEVPSKAPLKNLHTYLSTAVYVFQHFKRYDNLMKEMTKKPIFLVLVQRYQEFINTLQFQVTNYCVRVCATSILQDAESHHWDDYKAFYEGERCSFSIQMWHYFCWSLHYDLWTILPPKLAQEILVEVLEKSLSLLASRYARAHPSRKRTPQLRLDVTTILICTENMLWSVCTSVQKLLNPHQHTDDKIFKIHTHCNNLFTTLVILTSPLTELYKTFQHGLDESASDSLKSFFKQPLYWVSCISHFYPSLLRTPSAGGLKAEGQLKLLLSQPRCNWNLLLETLLHHDGLLLRILLKSSKRTFQEQVSDTENNLNQGPSLMEAIFKILYHCSFSPQTFANVFVSYMEEEQLWDFLYNIPGMRHLLFVKEMFYRYLYVPLKMFRSCIDTGFAESVVGESLPYIFSV

SEQ ID NO: 14831 - protein, 159 aa, Homo sapiens
MRNARSIRPARAESWRLSLCFLNWQDAIISKPHCPAGRTCPTAAASHGSRGAGHSDKDQGRSPKHVVCHVEHKKQCPAEFTDSRGVHNAAASISSQVGFPGHLTARTAAHKREALAVSPTPTLQVNAPGAKLRAPKAPRTPEALGRGPKRAGEWKTGCF

SEQ ID NO: 14832 - protein, 1079 aa, Homo sapiens
MDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQAQKKCLNQTSPISAPKTTDGLRQAQIPGLLSTTLPGQDSGSKVISASLGTAQPQQEKVVGSSPGHPAVQVESHSGGQKRPAAKQLTKGAFILQQLQRDQAHTVTPDKSHFRSLSDAVQRLLSYHVCQGSMPTEEDLRKVDNEFETVATQLLKRTQAMLNKYRCLLLEDAMRINPSAEMVMIDRMFNQEERASLSRDKRLALVDPEGFQADFCCSFKLDKAAHETQFGRSDQHGSKASSSLQPPAKAQGRDRAKTGVTEPMNHDQFHLVPNHIVVSAEGNISKKTECLGRALKFDKVGLVQYQSTSEEKASRREPLKASQCSPGPEGHRKTSSRSDHGTESKLSSILADSHLEMTCNNSFQDKSLRNSPKNEVLHTDIMKGSGEPQPDLQLTKSLETTFKNILELKKAGRQPQSDPTVSGSVELDFPNFSPMASQENCLEKFIPDHSEGVVETDSILEAAVNSILEC

SEQ ID NO: 14833 - protein, 521 aa, Homo sapiens
MEASVLSPTSWEKRRAWLRQSRNWQTQVLEEEAAAALQDVPDPEPSSLDDVFQEGNPINKIEDWLQDCGYSEEGFSEEAGQFIYNGFCSHGTSFEDDLTLGAEATLLAANGKLFSRSFLETARPCQLLDLGCSLASSSMTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 14834 - protein, 123 aa, Homo sapiens
MPDASLGSLGITWCFLESPLEVSSGRFGLARLLGSQDHGDDPAERGRTATDAWGPSRWGQSPGNGGGYCDASPPSALAPGDRAWALPASPSSGAPASQHCCLEKAGTRTKASPVWGRDGNTWN

SEQ ID NO: 14835 - protein, 469 aa, Homo sapiens
MLESIRVTEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 14836 - protein, 22 aa, Homo sapiens
PSSTQYHVLACLHLLVVPCLAW

SEQ ID NO: 14837 - protein, 1310 aa, Homo sapiens
MLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGRVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 14838 - protein, 505 aa, Homo sapiens
MVSNHYFLLCVNLPLREIHTPGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 14839 - protein, 121 aa, Homo sapiens
MRRSLKTSHFSEEPSTCLFLNHRNGSTDPTIILHISEPMFNGGKREMHGKRTPPFLLSLKFKDVCFGMPSLLPIHRLLKSLIYSRHMCLLCPKCITFLLVMADFGCVCVRHAVNNEMKAIA

SEQ ID NO: 14840 - protein, 505 aa, Homo sapiens
KSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGSLSAAQAGVQWRDHGSL

SEQ ID NO: 14841 - protein, 203 aa, Homo sapiens
KPYACNECVKSFCVKSSLIIHQRTHTGEKPYKCNEYGKTFHHKSTLTVHQRTHGEKPYKCNECRKSFYMKSHLAKHHRKYTKKPYECKQCGKTFQKSHLIEHQRTHPGEIPHECNKCGKSFCYKSPLTIHQRTHIEEKPYKCSKSVTYFCMKSHLTVHQRPHTRKNPFECNECRKMFYVKSNLINHQRTHTGEKPYEGNTCGK

SEQ ID NO: 14842 - protein, 324 aa, Homo sapiens
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLQDLLKNEQNQEEMTLDLLWDLSCHSSVSFPSTLSGTSFHFLSRTSLHSVEDNSSMDVKSMWDDIRLHLRRFLVSKLQSHNEINNSQQKILLKKQCLQQLLFLYPESEVIIKYQNIQNKLLANLLWNCFPSYNRDSNLDVIAHGYQSTMLKLYSVIKEDFNTLCEILAPSSMVKFIKETYLDTVTEEMAKFLENFCELQFRENAVRVVKTSKSSSKHRGAVHALG

SEQ ID NO: 14843 - protein, 152 aa, Homo sapiens
MPGLVFFKFANLGGGWGSRKMLEPGMCPAEMSLTPFVTRSLNLLCFSVTHRGRGKDNPLHFFLQLLAPSASASLGLGRETGPLPSPGLSPGLLSETFVSEGPLLTLQISWCGTECLMDGQGPLIHLHSQNIRISFGATQPPLLLVYEIRWNR

SEQ ID NO: 14844 - protein, 185 aa, Homo sapiens
MHGLCMVPSPHGHPGISGTCCAPGQAPDRHPLSLCAPTPGRKRQHHLVAWQPCPAPSCLWPHWTQPPSREAFGCRAGAGRAHPVAGGTQEPWLHLCSRRTCGQLTLQQGSGPKSLTHRVLSPDRAVDSFPFHPGTCWQELPGPHPGAATPAPPATPGHEKVQNSSGPSHNFLELRDSFLSTNGVR

SEQ ID NO: 14845 - protein, 1000 aa, Homo sapiens
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKEIPFNEDPNPNTHSSGPSTPLKNQTYSFSPSKSYSRQSSSSDTDLSLTPKTGMGSGSAGKEGGPFKALLRQQTQSALEQREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKAMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 14846 - protein, 404 aa, Homo sapiens
MLRAIAEERGRLSLRREVCGLGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 14847 - protein, 716 aa, Homo sapiens
MEDCLHTSSENLSKLVSWAHSHGTICSLIPNLKHLLSEGSHGNLTAMWGCSAGHAYHWPLTATCRAGSQERVCFQDNRSFNSDSPSIIGVPSETQTSPVERYPGRPVKAKLDCNRTRDSCDFSYCSEPSELDETVEEYEDENTLFDMVCESSVTDEDSDFEPQTQRPQSIARKRPGVVPSSLHSSSQTQMVDECSNDVIIKKIKQEIPEDYYIVANAELTGGVDGPALSLTQMAKPKPQTHAGPSCVGSAKLIPHVTSAISTELDPHGMSASPSVISRPIVQKTARVSLASPNRGPPGTHGTNQQVAMQMPVSTSHPNKQISIPLSALQLPGQDEQVASEEFLSHLPSQVSSCEVALSPSVNTEPEVSSSQQQPPVAPAITTEATAQCIPAYSTKLNKFPVFNINDDLNDLCTSAVSPNTTKATRYALNVWRYWCMTNGLKDHTDITKIPAVKLNELLENFYVTVKKSDGSDFLATSLHAIRRGLDRILKNAGVGFSITSSTFSSSTKKLKEKLWVLSKAGMSGARSRNIVYFSLSDEEEMWQAGCLGDDSPITLLSTVVKYNSQYLNMRTLQEHADLMYGDIELLKDPQNQPYFARTDSVKRESRSGSTRVCHGKIYHEHSRGHKQCPYCLLYKYMYIHRPPTQMEAKSPFYLTARKEATDMGSVWYEEQRMGLRSLRGIVPNLAKKVKLENCENFTFVSFTQVSRRLGSHSCCQ

SEQ ID NO: 14848 - protein, 534 aa, Homo sapiens
MRRHSETDVEEQTQELKTITQLQEQCRALQIQGVKENMDQNKATLALLRSNIRRGAQDWALAKKYDQWTISKACGKNLPLRLAHCRSTMEVVREKLRKYVFDRVNMHNLLIHLVRRRGQKLESMQLELDSLRSQPDASKEELRLLQIIRQLENNIEKTMIKIITSQNIHLLYLDLLDYLKTVLAGYPIELDKLQNLVVNYCSELSDMKIMSQDAMMITDEVKRNMRQREASFIEERRARENRLNQQKKLIDKIHTKETSEKYRRGQMDLDFPSNLMSTETLKLRRKETSTAEMEYQSGVTAVVEKVKSAVRCSHVWDITSRFLAQRNTEENLELQMEDCEEWRVQLKALVKQLELEEAVLKFRQKPSSISFKSVEKKMTDMLKEEEERLQLAHSNMTKGQELLLTIQMGIDNLYVRLMGINLPATQREVVLSNTLDLNSKLAYCEGKLTYLADRVQMVSRTEEGDTKVRDTLESSTLMEKYNTRISFENREEDMIDTFQFPDMDHSYVPSRAEIKRQAQRLIEGKLKAAKKKKK

SEQ ID NO: 14849 - protein, 1839 aa, Homo sapiens
MYHIDCRDQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYGYVLNESQSRQNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 14850 - protein, 507 aa, Homo sapiens
MVATGWARRSGLHPAPRPLRGAQEALAKNLWREERNRPLILSSLIIKKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 14851 - protein, 191 aa, Homo sapiens
QSGFMDLPKEKVGRKEQVEKLELGFIQLSGATDGMREYITEYESQGAVPNTRHQEKEDIIRLAQKEEEMKVKLLELQELVLPLVGDHEGHGKFLTAAQNPADEPAPGAPAPQELGAADEQGDFYEVSLDDSEEPAPGAAGEGSPHDNPTAQQIVQLPPVMQDTQEHPGLPGNPCVSFFYQAAENREINIII

SEQ ID NO: 14852 - protein, 124 aa, Homo sapiens
MEHMLLANHTDKATFTGTQRQRSCSGASVSQPRPLRGKLVGYWDPHSRLLSRGRALGSVSAPSTPRGRGWKATFDGCILHDDLLTKVHGFQSLIGLQQHLACGDSGSLMKNCHDGNRNNQRKLP

SEQ ID NO: 14853 - protein, 456 aa, Homo sapiens
MGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKFTEDLVGSVVHVLSHRQELRGWTGKEAPGPNPRVQVLAAQLLSDMKLQDGKRLLGPQWLDYDCDRAVIEDWVFRVPHVAIFLSVVICKGFLILCSSLDLTTLVPERQVDQGRGFESILDVLSVMYINAQLPREQRHRWCLLFSSELHGHSFSQLCGHITHRGPCVAVLEDHDKHVFGGFASCSWEVKPQFQGDNRCFLFSICPSMAVYTHTGYNDHYMYLNHGQQTIPNGLGMGGQHNYFGLWVDVDFGKGHSRAKPTCTTYNSPQLSAQENFQFDKMEVWAVGDPSEEQLAKGNKSILDADPEAQALLEISGHSRHSEGLREVPDDE

SEQ ID NO: 14854 - protein, 145 aa, Homo sapiens
MGPWPRDWLGKGWRLGSCEARAGAKEVSVIRHGAPNPAQSHLHVQARAQVHSEDGHSLPPVVDGEDEVLSLLVFVQDSQECCRQAVQGRQGRGVTWGLGLPSYHLRTLLSPVCVPARDQRAPRKCCEAVLACPLVETLVTTLLTR

SEQ ID NO: 14855 - protein, 550 aa, Homo sapiens
MGWSDLQPAMGGEAERFQAQLEVKLVTGGSPVVFTGNLTRQVGSKLAFSASLSHLLSDQANVTALLERKEENGRRVAALGAELFVPGLVGLRALGLLQQRGQLWTNSLRIQYSLLGQAKQAAHECSTSQKLRADSGSDGAYRLELRHELHCTQILAFSHKVQLWHEEDSGHLHSQLEVSYGKHWDKNSNKRHLRVSQTFKNDSGPALSNHFMEFVLQVPERQVDCRVQLYHLSLRLPYVESSSHLKVQYNGRPLFVAGGQWKDTSRATLWKWEGALNLDSPWLMVSAAHRLYWPHRAVFQAVLELTLGKAWTLKDLVVSVGCRSQGPNREGKIQVYTAATTYLRVSTVTVLAQSLFHSWSELESAWNAAVQGEIHAENSRDRKILNCWLKGPQQELNLTAAYRHLEWPRKTQVSLTAVRIGAQGQPRGLQLEGELEELRQDRTLYRKRGALLLRHPLHLPIPQSLLLQETFTADRRHQRYSLETRVVLNGREETLQTMVLGCQAGHPYVCAGLMHPYDGKVIPRNTEGCLVTWNQHTSLTLLSRLESGVQ

SEQ ID NO: 14856 - protein, 136 aa, Homo sapiens
RSRTGPVSLQGDPKQAPWSSSQSNSSRKTLFLSLCPPFPTQPQIHLHFTEHRASSHQGGPFKLQICLSSLYSNLLLHCHYREVHHMSGHRTESAGGHLFLPQDLRWKSPGLGVFAVQSVYELARRHNVSPFYSGPP

SEQ ID NO: 14857 - protein, 123 aa, Homo sapiens
MALLASNGCFIRCNEAGDIEAKSKTAGEEEMIKIRSCAERETKKKDDIPEEDKGNVKQCEINYVKKFQSFQEHKLKISKEDSKILKKAQKDGFLQETLLDSLGYEHRWKRWLLYWIKDMSRDG

SEQ ID NO: 14858 - protein, 96 aa, Homo sapiens
EVQLVESGGGLVQPGGSLRLSCAASGFTFSNHYTSWVRQAPGKGLEWVSYSSGNSGYTNYADSVKGRFTISRDNAKNSLYLQMNSLRAEDTAVYYC

SEQ ID NO: 14859 - protein, 145 aa, Homo sapiens
GESEDVTQFLQSHKKTLTNEKLFLMDGKRTWFLEMESTPGEDAMNTVKMTTKDLKYDRSLIDKAGFERTDSNFERSHTVGKMLSNSIMCYRDIFYERESQLMQQTSLLSYEIAIATPTFSNYYPDWSAPINIVARPSTSKKIMTC

SEQ ID NO: 14860 - protein, 131 aa, Homo sapiens
MRKPRRAGWETLSRKAPGPSAGLRPSPATCDTCHFPILGDGKATLPFAPGKTSRVPSDSGVFSSDPRANWSSIRNFPSAKCVGIELHESLSTSAEWLLRGRGGALPWIVRCLAATDLLLPGKKGVESCPVG

SEQ ID NO: 14861 - protein, 96 aa, Homo sapiens
EVQLVESGGGLVQPGGSLRLSCAASGFTFSNRSTHWVRQAPGKGLEWVGHSVSKKKKKKKKKKKKGRFTISRDDSKNTLYLQMNSLKTEDTAVYYC

SEQ ID NO: 14862 - protein, 128 aa, Homo sapiens
MYCQDSNICAVFAVQGGKVGRKHGIKRGRRPSIRSPAQRARGPWIHESKHPAFAKQQINLEMPNSRATTELAWVCSSTSRKKKWARSLTLSTAPLSPPPSLVHCEDCSCLPGCHSGDLYNLAPAERTC

SEQ ID NO: 14863 - protein, 718 aa, Homo sapiens
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKEFAGGIYSRLEAQIKASVPVSARQSSSEKNTRSKSRFGQGRPA

SEQ ID NO: 14864 - protein, 313 aa, Homo sapiens
MQEADASIKTAETKGRTWKYQNIEPGGGPQTSGKGGFGSLVLVFLGQRVGCNETGSMNLEKLQTRPNMTIFTRNNIATNFSSSSSSSYFSPPPPPVLLPLLLLLPQLFSSSSSSFFFSFSPSTSPLVSPCFFSSSSSFCFSVSLLPSSSPTSMTKFPKAVTTKIKTDKRDLIKLKGFCTAKETINRTNRQPIEWEKIFTNYASNKGLISRIYKELGQSDKQRPNNPIKKWAKDMNRHFSKEDIQVANKHEKMLSTSLIIGKMQIKTTVRYHLMPARKATIKKSENNRCWQGCRGKGTFTHCWSKCKLKCKCKM

SEQ ID NO: 14865 - protein, 287 aa, Homo sapiens
VFFLTGIPGLETRQIWTSIPFCCLYVIAISGNGMILFVIITESSLHEPMYHFLSMLSFMDLGLCLSTLTTMLGIFWFNAREISFDACIGQMFFIHGFTFMESSVLLAMAFDRFIAVCNPLRYATILTNSRIIKVGFAIVLRGTTALVPLLLLLKRLSFCRSHVLHHSYCFHPDAMKLSCTDTWINSAFGLAIVISTAGLDSVLILISYVLIVRSVLCIASPEEQKKAFGTCVSHISAVAIFYIPMISLSPVHRFGKHAPPLVHMLIANVYLLIPPVMNPIIYSVKTK

SEQ ID NO: 14866 - protein, 131 aa, Homo sapiens
MRKPRRAGWETLSRKAPGPSAGLRPSPATCDTCHFPILGDGNATLPFAPGKTSRVPSDSGVFSSDPRANWSSIRNFPSAKCVGIELHASLSTSAEWLLRGRGGALPWIVRCLAATDLLLPGKKGVESCPVG

SEQ ID NO: 14867 - protein, 1806 aa, Homo sapiens
MATRVEVGSITPLTAVPGLGEMGKEETLTRTYFLQAGEASGAPPARILEAKSPLRSPARLLPLPRLAPKPFSKEQDVKSPVPSLRPSSTGPSPSGGLSEEPAAKDLDNRMPGLVGQEVGSGEGPRTSSPLFNKAVFLRPSSSTMILFETTKSGPALGKAVSEGAEEAKLGVSGSRPEVAAKPALPTQKPAGTLPRSAPLSQDTKPPVPQEEAGQDHPPSKASSVEDTARPLVEPRPRLKRRPVSAIFTESIQPQKPGPGAAATVGKVPPTPPEKTWVRKPRPLSMDLTARFENKEALLRKVADEGSGPTAGDMAGLERPRAASKLDRDCLVKAEAPLHDPDLDFLEVAKKIRERKEKMLSKPEMGSPRALVGGSSGVTPSNDQSPWEEKAKLDPEPEKAAESPSPRLGRGLELAEVKSRVADGEAAAGGEWASRRSVRKCISLFREDSTLALAVGSESPLATPASPSAAPEPEKGVVSVQERIRGWTAESSEAKPEVRRRTFQARPLSADLTKLFSSSASSNEVKYEKSAELSGEFPKEPREKQKEGHSLDGACIPRSPWKPGTLRDKSRQTEQKVSSNQDPDSCRGGSSVEAPCPSDVTPEDDRSFQTVWATVFEHHVERHTVADQSGRCLSTTPPGDMAHARVSEPRPRPEMGSWLGRDPPDMTKLKKENSRGFDNPETEKLGPTTLLNGELRPYHTPLRDKYPLSENHNNNTFLKHLENPPTSQRIEPRYDIVHAVGERVHSEAISPAPEEKAVTLRSLRSWLSLKDRQLSQEVTPADLECGLEGQAGSVQRASLIWEARGMPEASGPKFGGNCPFPKWTGGAVVSSHKATVAVSEEHCAPGATSVRAIKAAIWESQHEGPEGARSKPGVGARGPPQGCPLDPLSRATNGPSDSQARTHPDAFAVQKGPFIVAAREGDPGPAQVPQPAVRMRKAGAMDQRMDRWRRRTLPPNVKFDTFSSLVPEDSPHVGHRRTDYVSPTASALRKPQLSHYRVETQEVNPGASRDQTSPAVKQGSPVEPKATFFAVTYQIPNTQKAKGVVLSGAESLLEHSRKITPPSSPHSLTSTLVSLGHEEALEMAGSKNWMKGREHENASILKTLKPTDRPSSLGAWSLDPFNGRIIDVDALWSHRGSEDGPRPQSNWKESANKMSPSGGAPQTTPTLRSRPKDLPVRRKTDVISDTFPGKIRDGYRSSVLDIDALMAEYQELSLKVPGEAQERRSPTVEPSTLPRERPVQLGGVEQRRRSLKEMPDTGGLWKPASSAEINHSFTPGLGKQLAETLETAMGTKSSPPFWALPPSAPSERYPGGSPIPADPRKKTGFAEDDRKAFASKHHVAKCQNYLAESKPSGREDPGSGVRVSPKSPPTDQKKGTPRKSTGRGEEDSVAQWGDHPRDCGRVPLDIKRAYSEKGPPANIREGLSIMHEARERRREQPKGRPSLTGENLEAKMGPCWWESGTGDSHKVLPRDLEKEDAPQEKERPLQQVSPVASVPWRSHSFCKDRRSGPFVDQLKQCFSRQPTEPKDTDTLVHEAGSQYGTWTEQCQSGESLATESPDSSATSTRKQPPSSRLSSLSSQTEPTSAGDQYDCSRDQRSTSVDHSSTDLESTDGMEGPPPPDACPEKRVDDFSFIDQTSVLDSSALKTRVQLSKRSRRRAPISHSLRRSRFSESESRSPLEDETDNTWMFKDSTEEKSPRKEESDEEETASKAERTPVSHPQRMPAFPGMDPAVLKAQLHKRPEVDSPGETPSWAPQPKSPKSPFQPGVLGSRVLPSSMDKDERSDEPSPQWLKELKSKKRQSLYENQV

SEQ ID NO: 14868 - protein, 246 aa, Homo sapiens
MAILPKVIYRFNAIPIKLPMTFFTELEKTTLKFIWNQKRACITKSILRQKKKAGGITLPDFKLYYTATVTKTAWYWYQNRDIDQWNRTEPSEIMPHIYNYLIFDKPDKNKQWGKDSLSNKWCWENWLAICKKLKLDPFLTPYTKINSRWIKDLNIRPKTIKTLEENLGITIQDIGMGKHFMSKTPKAMATKAKIDKWDLIKLKSFCTAKETTIRVNRQPTEWEKIFTTYSSDKGLISRIYNELKQI

SEQ ID NO: 14869 - protein, 20 aa, Homo sapiens
IMPLYSSSGDRTPISKNPTK

SEQ ID NO: 14870 - protein, 288 aa, Homo sapiens
MYVFQLFDYYSASGTTLLWQAFWECVVVAWVYGADRFTDDIACMIGYRPCPWMKWCWSFFTPLVCMGIFIFNVVYYEPLVYNNTNVYPWWGEAMGWAFVLSSMLCMPLHLLGCLLRAKGTMAECWKHLTQPIWGLHHLEYRAQDADVRGLTTLTPVSESSKVVVVESVMGQLSSHHQLTSGLWGKRLQYSILGVWAANLACSGFPPCALGWAQPQEGTPDTAPTSRLKADALPAPPVFCVAALTHVCLSRPVPRRLSDPKKGFPDTRTEAGGLGLREGGGPAGTFLLC

SEQ ID NO: 14871 - protein, 221 aa, Homo sapiens
ARRRGAAAALSRARVWGRLYPQPKLQEAAPLPRRGWDGGGHVGGGGDARGPRLEGESLPHPRLAPAAPSASPALAHPLVAHPARLDSSRNPGTGIYFGGSAAWRPGLSRVSQDRSPNSSRPLSLSGIPADVSPPAKTREEKREPALWSREKEEGATALQDHGWEKEWRGFRTFSVRLHVPVFISGSQALGSWARITCCPPLWSRGCFCKESSGRESMACLT

SEQ ID NO: 14872 - protein, 340 aa, Homo sapiens
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQETDSSEDEDIIGPMPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 14873 - protein, 399 aa, Homo sapiens
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSRNYLPILNSYTKIAPHPGKRGLSLGPEEKGTSGVQKKICTERLGPSLSSSEPTKAGAVPSSPSTPAPPSAKLAEDSALQGVPSLVAGGSPQTLQPVSSSHVAKAPSLTFASPASPVCASDSTLHGLESNSPLSPLSANYSSPLWAAEHLCRSPDIFSEQRQSKHRRFQNTLVVLHKSGLLEITLKTKELIRQNQATQVELDQLKEQTQLFIEATKSRAPQAWAKLQASLTPGSSNTGSDLEAFSDHPAI

SEQ ID NO: 14874 - protein, 104 aa, Homo sapiens
TCISFFLFLKKSLALLPRLEYSGTILAHCNLCLLGSSNSHASASQVAGITGMCHHVWLIFVFLVETGFHHVAQAGLELLVSSSSPALASQSTEITGMSQCAWPL

SEQ ID NO: 14875 - protein, 100 aa, Homo sapiens
CETPRLPEIALRALPRPGVSSLGTILCVPSVPVGPIVLTSATPESSRFTRPAPSTVPEAHRHSRILRLAPVPCRCYRPPAPAHTSRSTSLFYESPSTFNV

SEQ ID NO: 14876 - protein, 66 aa, Homo sapiens
TRNLWVFFFFFFETESCSVAQAGVQWAQSRLTTASPGCKQFSCLSLLSSWDYRHAPPHPANYCIFV

SEQ ID NO: 14877 - protein, 86 aa, Homo sapiens
VICPPWPPKVLGLQAKYHLHNHKFFVLRRSLALLPRLECSGAVLAHCNLCLPSSSNSPASASRVAGITGSCHHTRLIFCIFSREGV

SEQ ID NO: 14878 - protein, 83 aa, Homo sapiens
ISAHCNLCLPGSSDSSASASRIAGITGAHHHTRLIFVFLVETEFHHVGQAGLKWPQVIHPPWPPKCWDYRREPPRPALFFNFL

SEQ ID NO: 14879 - protein, 105 aa, Homo sapiens
LLPRLDCSGTISAHCNLPRFKRFSCLRLPTGITGAYHHTWIIFAFLVETGFHHVGQAGLKLLTSEQLGNTKSRSRPPGWSAMAPSWLTASSASRVHVILLPQPPE

SEQ ID NO: 14880 - protein, 115 aa, Homo sapiens
MSKCCAQSLNVPHPSEGSENITQDYLEKNWYLQRNTQNTEIKGPGGKVNNPPHPRLTFPGVVSEPPEGGRVPKVLKLAPSAKNLVKATKSLTIPMISIKHPPGVRLWSWGRRFIT

SEQ ID NO: 14881 - protein, 811 aa, Homo sapiens
MKARTRPLRASHDIVPTITQGSRDGHRSPARDPRTTPACRDSLQNGHTSDSSSGESSGGHRPRRGPSPSHVRFEDESAREAEFRHLERLQQRQRQVLSTVLQAADQGPLRSKPDLADYINGAPRLRDAGQGTFHRLVGSLDRRGHPAPPAPGSERRCQACGSCIDDPRPAQGKAPPVPRTLQELQAACGMERVLGGLSSPLRLLPAEPRLHMEWIRETHIGDTVCPAEVDSALDSTDNSDNCRTDSEEAGTSQAGWACGRTQGSSPRLRLRGSRPRGHRWSKKAEAELPWGLQAQQHLPRADDVEVENEVKEGRGHTPEGTLFLREDAKPPDLELKRVSLGPQWQPGPGLGSHQPHPLDSRTPCRTAYATTAPMTPESSGPGGQAQVTESHESLEIVSPSSLQQSHAEPSAPHQAWQPTASLCPEGWAPTPPPSRKTTSPVSHRKAALAGLLRLGDQTEPVGIPRPPSRSAVLRTCELPPSQTQPSRPQVRHPLLALSTNNCNNSAPRGLQEPYGGAVHEGRVERGPCSREPEPPLENSRDGGPQGFLGSADVATINSTGITLSLSSEESESSKESEGSLQRTGSGSGGHVLSRASAGAGTGPGSPSAAPLDQNKKRSSSIASTLGLKKLFSALGQSSRPKLGKSRSYSVEQLQPAPPGLTSQSRAPSLQSLHPVSPSHQRRKAASFQNLHSLLSSKGNRSSLYLVAGPGDHSAAGRPAKTSPRRALSVEDVGAPSLARTVGRLVEVFPDGTSQLQLQRSPGGTFGFCVASGNGRPDSGMPSPLPQPHGWGGLSKQGRAFWLWSEAFLVFG

SEQ ID NO: 14882 - protein, 1190 aa, Homo sapiens
MEGTEAAAAKPAGGSPQGPKTGSGTASPVEGTSAVEWSGPEPQLDNGHPPRPWPCPQENRTSSLMAPQPPRVWGVQLQGPSVLESKVRALKEKMTVAKQGVSPCSASQEWSSPKKPQCRRGKAGRAGTPSEGSFLPGAVVAPRTQNLPDGQLDGSINEEQPARDGGPRLPRPPAPGREYCNRGSPWPPEAEWTLPDHDRGPLLGPSSLQQSPIHGVTPGRPGGPGHCNKIIHIPSPRTGRSYPFPDGVVTEADLDSTSLTSEEVFVPRTALLGERWRAGDLEALGAGSSVLSLSDRVERNRLLLQEMLNVSGQSPRKVGTPAWTPSWDTAAPERPVGDVDWASGTSLQDSGQNRTVGPNPEPVLSPRHEEATHLLQRARMKARTRPLRASHDIVPTITQGSRDGHRSPARDPRTTPACRDSLQNGHTSDSSSGESSGGHRPRRGPSPSHVRFEDESAREAEFRHLERLQQRQRQVLSTVLQAADQGPLRSKPDLADYINGAPRLRDAGQGTFHRLVGSLDRRGHPAPPAPGSERRCQACGSCIDDPRPAQGKAPPVPRTLQELQAACGMERVLGGLSSPLRLLPAEPRLHMEWIRETHIGDTVCPAEVDSALDSTDNSDNCRTDSEEAGTSQAGWACGRTQGSSPRLRLRGSRPRGHRWSKKAEAELPWGLQAQQHLPRADDVEVENEVKEGRGHTPEGTLFLREDAKPPDLELKRVSLGPQWQPGPGLGSHQPHPLDSRTPCRTAYATTAPMTPESSGPGGQAQVTESHESLEIVSPSSLQQSHAEPSAPHQAWQPTASLCPEGWAPTPPPSRKTTSPVSHRKAALAGLLRLGDQTEPVGIPRPPSRSAVLRTCELPPSQTQPSRPQVRHPLLALSTNNCNNSAPRGLQEPYGGAVHEGRVERGPCSREPEPPLENSRDGGPQGFLGSADVATINSTGITLSLSSEESESSKESEGSLQRTGSGSGGHVLSRASAGAGTGPGSPSAAPLDQNKKRSSSIASTLGLKKLFSALGQSSRPKLGKSRSYSVEQLQPAPPGLTSQSRAPSLQSLHPVSPSHQRRKAASFQNLHSLLSSKGNRSSLYLVAGPGDHSAAGRPAKTSPRRALSVEDVGAPSLARTVGRLVEVFPDGTSQLQLQRSPGGTFGFCVASGNGRPDSGMPSPLPQPHGWGGLSKQGRAFWLWSEAFLVFG

SEQ ID NO: 14883 - protein, 134 aa, Homo sapiens
MIPVRGLWYCYLQVKKVRLREAERLGPKSQCPAECGAASWISWVLQHQQLLASEWATKDGRGTWGSKPSCTVPALSATSQLLQLGRLNSDLQFVRQRAKKSVSSPSLLQFWCCLSRLSFHALNQKINSTNINIT

SEQ ID NO: 14884 - protein, 384 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQINTAVPLPAASSTSLRSTKHSATSCFISTWSLAGITYWSPTCANTIPDNTSAASS

SEQ ID NO: 14885 - protein, 564 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQINTAVPLPGYTQPSAISSVPPQPPYYPSNGYQSGYPVVPPPQQPVQPPYGVPSIVPPAVSLAPGVLPALPTGVPPVPTQYPITQVQPPASTGQSPMGGPFIPAAPVKTALPAGPQPQPQPQPPLPSQPQAQKRRFTEELPDERESGLLGYQHGPIHMTNLGTGFSSQNEIEGAGSKPASSSGKERERDRQLMPPPAFPVTGIKTESDERNGSGTLTGSHGECDIAGGTGEWLRLV

SEQ ID NO: 14886 - protein, 614 aa, Homo sapiens [sequence omitted]

SEQ ID NO: 14887 - protein, 526 aa, Homo sapiens
MIQSQISFEDVAVDFTLEEWQLLNPTQKNLYRDVMLENYSNLVFLEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTGEKNYRCSDCEEAFFKKSELIRHQKIHLGEKPYGCIQCGKTFFGKSQLLTHHRTHTGEKPYECSECGKAFTQKSSLISHQRTHTGEKPYECSECRKTFSEKSSLIHHQRTHTGEKPFECSECRKAFAWKPQLLRHQRI

SEQ ID NO: 14888 - protein, 1354 aa, Homo sapiens
MSSTADLLDTILKAIEENITTENSCSLLMALDTLLNSDSTKEMGFTCKIQALRDKLWIFLVQSFYAVRHTESWKLMSTDDQQKIQAAAFDKGDDRRLGKKPIFSSSQQRKQVSDSGDIKIKSWRGNNKKECWSYLSTNKKMKSDGLGASGHSSSTNRNSINKTLKQDDVKEKDGTKIASKITKELKTGGKNVSGKPKTVTKSKTENGDKARLENMSPRQVVERSATAAAAATGQKNLLNGKGVRNQEGQISGARPKVLTGNLNVQAKAKPLKKATGKDSPCLSIAGPSSRSTDSSMEFSISTECLDEPKENGSTEEEKPSGHKLSFCDSPGQMMKNSVDSVKNSTVAIKSRPVSRVTNGTSNKKSIHEQDTNVNNSVLKKVSGKGCSEPVPQAILKKRGTSNGCTAAQQRTKSTPSNLTKTQGSQGESPNSVKSSVSSRQSDENVAKLDHNTTTEKQAPKRKMVKQVHTALPKVNAKIVAMPKNLNQSKKGETLNNKDSKQKMPPGQVISKTQPSSQRPLKHETSTVQKSMFHDVRDNNNKDSVSEQKPHKPLINLASEISDAEALQSSCRPDPQKPLNDQEKEKLALECQNISKLDKSLKHELESKQICLDKSETKFPNHKETDDCDAANICCHSVGSDNVNSKFYSTTALKYMVSNPNENSLNSNPVCDLDSTSAGQIHLISDRENQVGRKDTNKQSSIKCVEDVSLCNPERTNGTLNSAQEDKKSKVPVEGLTIPSKLSDESAMDEDKHATADSDVSSKCFSGQLSEKNSPKNMETSESPESHETPETPFVGHWNLSTGVLHQRESPESDTGSATTSSDDIKPRSEDYDAGGSQDDDGSNDRGISKCGTMLCHDFLGRSSSDTSTPEELKIYDSNLRIEVKMKKQSNNDLFQVNSTSDDEIPRKRPEIWSRSAIVHSRERENIPRGSVQFAQEIDQVSSSADETEDERSEAENVAENFSISNPAPQQFQGIINLAFEDATENECREFSATKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGDIDDCDTLAQTRMYDHRPSKTLSPIYEMDVIEAFEQKVESETHVTDMDFEDDQHFAKQDWTLLKQLLSEQDSNLDVTNSVPEDLSLAQYLINQTLLLARDSSKPQGITHIDTLNRWSELTSPLDSSASITMASFSSEDCSPQGEWTILELETQH

SEQ ID NO: 14889 - protein, 787 aa, Homo sapiens
MGDPGSEIIESVPPAGPEASESTTDENEDDIQFVSEGPSRPVLEYIDLVCGDDENPSAYYSDILFPKMPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNCLNTRYSATRIAEHIAKEMKMKIFKNIIEENAKICIIIDEASTVSKKTTLVIYLQCTIQSAPAPVMLFVALKELVSTIAECIVNTLLTTLNDCGFTNEYLKANLIAFCSDGANTILGRKSGVATKLLENFPEIIIWNCLNHRLQLSLDDSISEIKQINHLKIFIDKIYSIYHQPNKNQTKLLGTVAKELETEIIKIGRVMGPRWAACSLQAATAVWHAYPILYMHFSHSYSGLAKRLANINFLQDLALMIDILEEFSVLSTALQSRSTNIKKAQKLIKRTIRALENLKIGTGKYESQIEDLIKSDKFKDIPFNKNNKFNALPRSILLDNIIQHMNLRLLSDRNHEDIFNYFDLLEPSTWPYEEITSPWIAGEKTLFHLCKILKYEVDLNDFREFVNNNIKSNNVSIPTTIYKAKKIVSTIAINSAEAERGFNLMNIICTRVRNSLTIDHVSDLMTINLLGKELADWDATPFVKSWSNCNHRLATDTRVRQKSTKVFHENQLAIWNLK

SEQ ID NO: 14890 - protein, 211 aa, Homo sapiens
MQLGEHTHPQKNPKSLAGCLLPNPHPQLQLRGKRAAGLLLRRNPWRHPQAPGGSSTWAPSLPPILAPQAYLNFAPPTPVPGGSPGTEAQPVAPANALGSRSKLNLTQPSCLSSGSHLPLPFPAGMCPHPANPTWALRKGAEVPQGPPLSHTRKALCLAASGVGALLLEVPRHPGWGQQSAAGFQQVFQEGAGTHFPSVRVQPGRGKLQGQR

SEQ ID NO: 14891 - protein, 495 aa, Homo sapiens
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 14892 - protein, 114 aa, Homo sapiens
MCGWEDSQKPSVPSHGPKTPSCKGVKAPHSSRPRAWKQDLEQSLAAAYVPVVVDSKGQNPDKLRFNFYTSQYSNSLNPFYTLQKPTCGYLYRRDTDHTRKRFDVPPANLVLWRS

SEQ ID NO: 14893 - protein, 107 aa, Homo sapiens
MWLSPWSTCPPHPLPSCLTACCSPAHQPVRGSAQPPASDLCTCVTCCSGPHPNYPPAHLLPTSSLPICPGLICCLLTCLLVDCFSALLSACETRDLSPWKARRVLLR

SEQ ID NO: 14894 - protein, 832 aa, Homo sapiens
MGTTASTAQQTVSAGTPFEGLQGSGTMDSRHSVSIHSFQSTSLHNSKAKSIIPNKVAPVVITYNCKEEFQIHDELLKAHYTLGRLSDNTPEHYLVQGRYFLVRDVTEKMDVLGTVGSCGAPNFRQVQGGLTVFGMGQPSLSGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVDRAITACAELHDLKEVVLENQKKLEGIRPESPAQGSGSRHSVWQRALWSLERYFYLILFNYYLHEQYPLAFALSFSRWLCAHPELYRLPVTLSSAGPVAPRDLIARGSLREDDLVSPDALSTVREMDVANFRRVPRMPIYGTAQPSAKALGSILAYLTDAKRRLRKVVWVSLREEAVLECDGHTYSLRWPGPPVAPDQLETLEAQLKAHLSEPPPGKEGPLTYRFQTCLTMQEVFSQHRRACPGLTYHRIPMPDFCAPREEDFDQLLEALRAALSKDPGTGFVFSCLSGQGRTTTAMVVAVLAFWHIQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 14895 - protein, 475 aa, Homo sapiens
MPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAAQYRRGLELSKQAAQLGATARGAGEAERAEFPELAAFASTQRAFQAELTHFYMAAERQRTDLETLLHLHRFCKR

SEQ ID NO: 14896 - protein, 159 aa, Homo sapiens
MHQTHAIQRLEVLPSFSNESPTSRETSESWTNQDDIFYAYASMSPGAEHRGTTQLLRFQLAPIKKLEGSLQTHFLLSSLHPRMTFPGRAGGGEAGSRPPRRPWAGILILQLPSTRGGRRSGHGAVRSWGPWKVVAEQPVGGTDPPAHGGRGRPSPNENT

SEQ ID NO: 14897 - protein, 1035 aa, Homo sapiens
MVVFVGRRLPALLGLFKKKGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 14898 - protein, 79 aa, Homo sapiens
MIFTPFLPPADLSVFQNVKGLQNDPEEWVAVSDATEDPSGGTGLPREPALLRGSWRSRFQRALACFTKCFRGGYRALGI

SEQ ID NO: 14899 - protein, 75 aa, Homo sapiens
MIFTPFLPPADLNVKGLQNDPEEWVAVSDATEDPSGGTGLPREPALLRGSWRSRFQRALACFTKCFRGGYRALGI

SEQ ID NO: 14900 - protein, 738 aa, Homo sapiens
MEDCLHTSSENLSKLVSWAHSHGTICSLIPNLKHLLSEGSHGNLTAMWGCSAGHAYHWPLTATCRAGSQERVCFQDNRSFNSDSPSIIGVPSETQTSPVERYPGRPVKAKLDCNRTRDSCDFSYCSEPSELDETVEEYEDENTLFDMVCESSVTDEDSDFEPQTQRPQSIARKRPGVVPSSLHSSSQTQMVDECSNDVIIKKIKQEIPEDYYIVANAELTGGVDGPALSLTQMAKPKPQTHAGPSCVGSAKLIPHVTSAISTELDPHGMSASPSVISRPIVQKTARVSLASPNRGPPGTHGTNQQVAMQMPVSTSHPNKQISIPLSALQLPGQDEQVASEEFLSHLPSQVSSCEVALSPSVNTEPEVSSSQQQPPVAPAITTEATAQCIPDQDERAAELSREQNEKTIRSTQTALRNFREFLISKYPSETREIYVIPCKELDAYLASFFVDARQKDGSEYEPNSLANYQCGLERYLKEHRYGYSITRDKEFKRSQEALKQKQIELRCKGKGNKPHKSMKLTFADELILRKRGLLSRYNPEGLLNLVWLNNTKAFGHCTGFHGSTLKWGDIRLRVTETGLEYLEWMGQDTGDLNAKTKRGGTDSRVYATQHAPQTCPVQDYKEYAQRRPPAMRYEDAPFYLSIKPVVNLAALHWYNCQALGKNKLAKMVKTMCEKGNIPGRKTNFSVYQSCSTLSEAQSNQLVLICNNLSQQAAQSVAGHSNNGNFIVSASYDSSSDTA

SEQ ID NO: 14901 - protein, 129 aa, Homo sapiens
MKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKKTLENLE

SEQ ID NO: 14902 - protein, 129 aa, Homo sapiens; identical to SEQ ID NO: 14901

SEQ ID NO: 14903 - protein, 154 aa, Homo sapiens
MCTVAHTCIEHMCTYMRLHPLAHPHTCALAPICTHVHTLAHMCICRNAPLHLCDTPAHLHTPICIQAQTHSHTFAHTATNLHKQHLYTDTYPFVPIQCTLTHLHTAVLAHTFAHTHLHTCTHTTHLSVQHTYLCAYMHICTCTQQWHTLLYHSP

SEQ ID NO: 14904 - protein, 41 aa, Homo sapiens
RKNGQQQPRGRPGSARPPAQPPECGADQRVTLLTGDPVSAA

SEQ ID NO: 14905 - protein, 123 aa, Homo sapiens
MVDGRTRTIINDIFFTEPTPEMSSLPVRSHSSLSLNLVSLMVICRGIIKLVIHFRMYCPPRLKAKHIEPTLRPVPLKELRISHWPNECIRHSASVPMATGANGLETKDETKRNAEKCACSVFL

SEQ ID NO: 14906 - protein, 123 aa, Homo sapiens; identical to SEQ ID NO: 14905

SEQ ID NO: 14907 - protein, 140 aa, Homo sapiens
MDCKSPKRANICPHLPGGGLFSTPPSQAAWRTLLTALCFPGPTCTGPMREGPRAVYNPPRAHRNSSDNCVMKHLLCAGDKNGTRRHALPSPLEGSFQPGRQIPPPQTPSTDPQTLPLSFRSLLRCHQLCAASLPPSLKLP

SEQ ID NO: 14908 - protein, 140 aa, Homo sapiens; identical to SEQ ID NO: 14907

SEQ ID NO: 14909 - protein, 216 aa, Homo sapiens
AWTVSGLLSAAFEPEVPASLSQKSDHRSSLPSSPSLPLSKTLAVAYDPEDSSAANWCFGLCAVPGPASLDLGRPWPVEEAQVKAGGCCWLSSLLLEVSASLRMGRTDPLTGLQSLEGSIGQGNGGHVTSCRAPCHRPKEQLCPLSVGGPGGEVDRHLPPTGIWQQEPGLLCKKGRPKGEQWPIKTLENKHPFPRWLQIITSCKSTPGEQLTFISLS

SEQ ID NO: 14910 - protein, 239 aa, Homo sapiens
PQMSAVYTPPSVSTHQMPRNPNPQQRPQMSAVYTPRSAPTRCPQMSAVYTPPSAPTDQMPRNPNAQQRPQMSAVYTPPSAPTDQMPRNPNPQQRPQMSAVYTPPSAPTDQMPRNPNPQQRPQMSAVYTPPSAPTDQMPRNPNPQQRPQMSAVYAPPSAPTDQMPRNPNPQQRPQMSAVYAPPSAPTDQMPRNPNPQQRLQMSAVYAPPSAPTDQMPRNPNPQQRPQISAPRCQLSIRHR

SEQ ID NO: 14911 - protein, 79 aa, Homo sapiens
MKLAKTAVLDPATYTSFSPGLSTCSSSQPPGDRRKGLLGCVGSGHCPLPTPAQFPKVQRPPTLLGGKNTSTQTTLHPVI

SEQ ID NO: 14912 - protein, 122 aa, Homo sapiens
DPGSLRCPVCLSMEGCLEGTTEEICPKGTTHCYDGLLRLRGGGIFSNLRVQGCMPQPVCNLLNGTQEIGPVGMTENCDMKDFLQLKPVGLLEEHNVGEKERGQGQHQCVQLDWQKRAATGVS

SEQ ID NO: 14913 - protein, 151 aa, Homo sapiens
MHAGKRSPLTQSISCVCLPELGALWEIESARVNLRVSGREASREMESSPRPHRIAGVKRFLKHAGKWSLRWFLSPRWILQFRRWARKWSRFTRSSFQVRWAAVPAGKCSQHQGLSAVATASPGVFWEMEFDVSSPLTEGAGSPMSSKHAGE

SEQ ID NO: 14914 - protein, 121 aa, Homo sapiens
MIDSPRKEGALSPPLGGWRLGDRRCAGGKRTERRTPEKLWGIRGEKEGVKREGRLSRGGGAGAGAGAGGVTAPRPPLPALHSAAPGLPPPPPPPPPPPPLPPPPGVAGCGQNRSPNRAAGE

SEQ ID NO: 14915 - protein, 241 aa, Homo sapiens
MAPATDTAWLPPHPEIQLRLLCPGETYGKLMGGSPSAGPTTQSQPHALRPGLRGRGGWWPQPFWIHSPPLTHSVGTFICLDGLVCALTAPGLGVGLTPAPWRPPGQSRMLEGHGPWPTPGSRPGPTCVCLLTPASSSLRPCLSDRGTCPGAPQGAVGTCRASPQSPCHRHPSLRSGLEWTQPPDQDQGLLTPGSPPLVSGVTQTPWTSPFCPPRPTPWVGAAFTAANPCPPAPTASSVTGL

SEQ ID NO: 14916 - protein, 237 aa, Homo sapiens
MPVHPAWLGSACLPHASHGPAPQSSVGGLLVSVKSPPGDVHAARACAPGRHSGEGPPQGNLSPSCPAEAGHGCASTGRQVGVSGAGSSPSGPAPCVKCSAWVGTCFPLSLLQAAGGPAGSPNGFCPEPWAPDHAPTLHGLNKSLCQGPRSGGAQRKPRAHTGEGVSGLGLTQPRLSSSLRISWHLLACVATQVGCACRLREKTLGEDYVSAFLPSTGPSWAHCDQTMCKSTRESGRS

SEQ ID NO: 14917 - protein, 321 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILVSLMSQTSILQNY

SEQ ID NO: 14918 - protein, 595 aa, Homo sapiens
MVSNHYFLLCVNLPLREIHTPGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 14919 - protein, 635 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSCVKERALFVNFARIRLSSSHFRQQHVEDVQRAGLAFTNSASSPPSAPGVRGSQRGENFWKVWPLQQHDAPEYCEKDCSTCLMITPICVYYW

SEQ ID NO: 14920 - protein, 635 aa, Homo sapiens; identical to SEQ ID NO: 14919

SEQ ID NO: 14921 - protein, 131 aa, Homo sapiens
MDSTHPQHCACNSQIRPRWDCVAHCFLWAPGLPSRDDPGADKGEASGGVGTVSLTLSQPRERSLQVKKVFVKGMKKERALGEGAAWWQSQRLVSPGKHDRVSTHRKSQSVFTGVSAGDKQFTTTFSIVFTI

SEQ ID NO: 14922 - protein, 340 aa, Homo sapiens; identical to SEQ ID NO: 14872

SEQ ID NO: 14923 - protein, 140 aa, Homo sapiens
MWPFRLRCPIYFKTRLLYSSSQDGFLSSSTNYYNHRTYPGLVNWLFVLTEPELTGELGDDDRKGMHTGGIIRWLGRPSSQLKPIFHAEERRVPPPPERLVGRASPREQATVFKRICAPLHAEVFCRAGLCACHPDCTAAG

SEQ ID NO: 14924 - protein, 135 aa, Homo sapiens
MVATWGGRQLLPQCSGPPLTPGSPAPSVAQASRPAPPSPRKTSPGPPQPSASPSLPFSPLLAGCSRLLPVLAPSLSSVHRCPLGARASRLPWKLEAGTSSSGDRPLCLHSGQRGACLTDEQGSTLSPRQRRGPGK

SEQ ID NO: 14925 - protein, 157 aa, Homo sapiens
MLSVSRPCFSQGAFLGRTLGSVWAQGGSRLPLCFWYRIRCGRPAVVHIGGEGARWEKGARGRKEHRLRRSDLGSRPVPFLAQGIPDIVIRLLCLSAGSASSHQASDPLSSAAATLAAELDWALVSQKSSEDLAPPSLLLNCISFLITQCPHPRWLPG

SEQ ID NO: 14926 - protein, 208 aa, Homo sapiens
MSPTKDSHPSPHFPRDSGIHAPTPPDSGALTLSPPVSQGPGVGPRTGRGNRLCRPPGRSAARSFCLLPGPPLGTGALGSPRAAQGLGFRGSGQRARHNSFTSPSPPGAHHPLGTHTRALPPPLARCPCAALLAGRECHGGPSPAAPRPLPGTSLTWPSRAPLPRPPPRERQGPGDRSPSPSAPSCPGVGASSPRRRKPREAAGLTPDG

SEQ ID NO: 14927 - protein, 415 aa, Homo sapiens
YDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNVSWPGWRARQVALGPPCTGLHARAPDPRVICSRKGRVSVPLRQACWWL

SEQ ID NO: 14928 - protein, 577 aa, Homo sapiens
MADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREAIKLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHGTFRLSPLKSTRKKMGMHRTPEELEENQILEDIFFI

SEQ ID NO: 14929 - protein, 199 aa, Homo sapiens
MLPVQRRKLDPLLKKYRHHKKATRTKRRRKEKMEAQCSPVPPTPSTPPQSEEDEAVDKKPTLLSAQEDTPDLLHEDRLQYLQEEGSGVMHQECQIQSCELSVAQKPRPSSPAVTSLASPPLCFGSFLSCVCQTFSRSRKQKPPRRKGNNQAEAGGDAEVLRPGPAKPELSLSKTCSHLKSIELSFVFSFIVLSVCHCSS

SEQ ID NO: 14930 - protein, 2205 aa, Homo sapiens
MPLFFSALLVLLLVALSALFLGRWLVVRLATKWCQRKLQAELKIGSFRFFWIQNVSLKFQQHQQTVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPEVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 14931 - protein, 709 aa, Homo sapiens
MDQKLSKLVEELTTSGEPRLNPEKMKELKKICKSSEEQLSRAYRLLIAQLTQEHAEIRLSAFQIVEELFVRSHQFRMLVVSNFQEFLELTLGTDPAQPLPPPREAAQRLRQATTRAVEGWNEKFGEAYKKLALGYHFLRHNKKVDFQDTNARSLAERKREEEKQKHLDKIYQERASQAEREMQEMSGEIESCLTEVESCFRLLVPFDFDPNPETESLGMASGMSDALRSSCAGQVGPCRSGTPDPRDGEQPCCSRDLPASAGHPRAGGGAQPSQTATGDPSDEDEDSDLEEFVRSHGLGSHKYTLDVELCSEGLKVQENEDNLALIHAARDTLKLIRNKFLPAVCSWIQRFTRVGTHGGCLKRAIDLKAELELVLRKYKELDIEPEGGERRRTEALGDAEEDEDDEDFVEVPEKEGYEPHIPDHLRPEYGLEAAPEKDTVVRCLRTRTRMDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERPEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 14932 - protein, 662 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 14933 - protein, 183 aa, Homo sapiens
NMNRYSFMLSGNHLLFHLLLWPAQTARLLKHIFPTGSCKLRDVAEHLLQCPQTGHECCKAQNRANLVEGWFSQNTQRGPSHDGVAEFHMSLTVSCPDPTPSTDPQGRHNREPILGRDDDFMCKQVKFRMCVVGRDGNAQSSVRYTGPLYRRKIRTEFLFVVFLLETRELKPQVNKNVQGTRPS

SEQ ID NO: 14934 - protein, 56 aa, Homo sapiens
MAILKMGPKIVLEWSGGHPSKDPSSYYLIILHKDTSSTLVDCHFQHHNLHKVGFLY

SEQ ID NO: 14935 - protein, 199 aa, Homo sapiens
GRAARRHHDSCEDAALPGRSDLCRALHPARPAARGGRPADGGCPAVPAEGLWRHLQQVGAATHPHLMRGPSLSWAIPATHPLGAAPLGNPGPGEPIWLPCVGGAEVRAQLGSFYSWESKSSLPSTPLSLLVSCGGSALTTHAFPPIGGPIPSRFPAANKYLPSSARVQGSVGISIYPATDKATYLSTWSAHSGRRERPK

SEQ ID NO: 14936 - protein, 71 aa, Homo sapiens
MKIVHVNVMGVGGWGAVFLDMWHVTQESKRPIISKMPAWIFPCHPLDEQTYHMALNAATFPKNATWIGPLW

SEQ ID NO: 14937 - protein, 48 aa, Homo sapiens
MSDFPVHSKYFLISSLQVLKMHKKDFTSQVLLRIYFDLICMLVKLHVL

SEQ ID NO: 14938 - protein, 286 aa, Homo sapiens
MSLPIGIYRRAVSYDDTLEDPAPMTPPPSDMGSVPWKPVIPERKYQHLAKVEEGEASLPSPAMTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 14939 - protein, 1079 aa, Homo sapiens; identical to SEQ ID NO: 14832

SEQ ID NO: 14940 - protein, 1079 aa, Homo sapiens; identical to SEQ ID NO: 14832

SEQ ID NO: 14941 - protein, 263 aa, Homo sapiens
MWPQPCLPPHPTMLEETQQSKLAAAKKKLKEYQQRNSPGVPAGVKMKKKNTGSSPETATFGGCHSPGASRYQELELALDSSSAIINQLNENIESLKQQKKQVEHQLEEEKKTNSEIHKAQMEQLEAIDILTLEKADLKTTLYHTKRAARHFEEESKDLAGRLQYSLQRIQELERALSAVSTQQQEEDRSSSCREAVLQWRLQQTIKEQALLNAHVTQVTESLKQVQLERDEYAQHIKEERARWQERMWKMSVGLSPHPRHPQQ

SEQ ID NO: 14942 - protein, 19 aa, Homo sapiens
WIFIFKCSVMYVHFFFAFF

SEQ ID NO: 14943 - protein, 205 aa, Homo sapiens
MNSWPWLFDSNFCSAVEIILEPEKKIPNSTLHFCEELVPNSGSLFGKNICCGKQCCICDLKSLLELDRDGEFQPERPKNSCPALLNAISRRTSIFPPPTSLLLPVTLASSQCCWATSGSAGGRGIAPTPGGQPCGSSRKSGSSCAWRWSPSGGSPWPCSRAGGAWRRLGTSLDTHPAGSRACRAVHQLAGESPTPRQARRPPFPT

SEQ ID NO: 14944 - protein, 72 aa, Homo sapiens [sequence omitted]

SEQ ID NO: 14945 - protein, 103 aa, Homo sapiens
MKLKSLFGEITFTFGISKEKLKILDDLTLLPLLVKQYKMLWSYKLPGSGIVIWSTFHAVMDSEWRRQNAELNLITNKHFLKNLQSKHLDVKILKTKNKLVEGI

SEQ ID NO: 14946 - protein, 22 aa, Homo sapiens
DGKIMLHVCCISLCSVLVWKFP

SEQ ID NO: 14947 - protein, 78 aa, Homo sapiens
VLLFIFYLLIFMFSFFETRSHSVTQAGVQWHDHSSLQPQLPGLKQSPTSASQSSWDHGCAPRHPIHLPQTPKVLGLQV

SEQ ID NO: 14948 - protein, 98 aa, Homo sapiens
LECSGTVLAHCNLCLLASQAAGITGTSHHAQLIFVFLVETWFHHVGQAGLELLTSGDPPASVSENAGITGVSHRAWPGPQFFNLEQGFSMLVRLVSNS

SEQ ID NO: 14949 - protein, 150 aa, Homo sapiens
RNRIQYNQSQKDILQSWFQHDPFPDKAAREQLAKEIGVPESNIQVWFKNYRVKQRKLDYKCFSEKDQTQGHDQSQHLTQEYLPKEARQKQTFITWTQKNRLVQAFERNPFPDIATRKKLAEQTGLQESRIQMWFQKQRSLYLKKSRMEPM

SEQ ID NO: 14950 - protein, 1216 aa, Homo sapiens
MAAMAPGGSGSGGGVNPFLSDSDEDDDEVAATEERRAVLRLGAGSGLDPGSAGSLSPQDPVALGSSARPGLPGEASAAAVALGGTGETPARLSIDAIAAQLLRDQYLLTALELHTELLESGRELPRLRDYFSNPGNFERQSGTPPGMGAPGVPGAAGVGGAGGREPSTASGGGQLNRAGSISTLDSLDFARYSDDGNRETDEKVAVLEFELRKAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFELTLRGMSEALVDKRVAPALVTLSSDPEFSVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 14951 - protein, 144 aa, Homo sapiens
MERASGLSPGGGLGATSRQMSPGTQLANPPDHGDKDCLGRISPGSGKQIQAAGQLPGPPTSLAPAQGRLRSLTPWGLQTPEHSEPEGIGHLQAATEAVLPHSTQNLITKRNLMVQARVQWRDLGSLKPPPPRFKQFSCFSLPSS

SEQ ID NO: 14952 - protein, 58 aa, Homo sapiens
PGGAAAAASVMAPRRGRCFCTSICGGRGARPQLPRTCGDGTQHCGRGKPALAAAEEWP

SEQ ID NO: 14953 - protein, 97 aa, Homo sapiens
MGSIPSKPCNNPEGPLLQGMEAADWTGIGVCLPPGGARGHIYCCTRLCHQRAASAHRSLLLPRTVQTGGTEREKPGPGQRKRGAHCSACKRSSTRPS

SEQ ID NO: 14954 - protein, 167 aa, Homo sapiens
MDLIKVLYVKKPLIFPMYLIYKHENLILERNPLDVRSVVMVSVIPLTFDIMRELTLEKNPMNVKNVVKPSDIVVPYENMTELILERNPMSVRIIGKCLVMPIIFVAIKELTPERNPISKDCGKAFRSSSFCQQHKSTHTGEKPYECKKCGKTFRFYSSLPKHKRTHT

SEQ ID NO: 14955 - protein, 135 aa, Homo sapiens; identical to SEQ ID NO: 14924

SEQ ID NO: 14956 - protein, 1842 aa, Homo sapiens
MELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPVVSPTGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 14957 - protein, 28 aa, Homo sapiens
DAVILFSVWRLKKKSRVLFFIYIIAISV

SEQ ID NO: 14958 - protein, 36 aa, Homo sapiens
MEETESGSGRKERRWLGAVAHVCNPSTLGGQVGRII

SEQ ID NO: 14959 - protein, 164 aa, Homo sapiens
MGQKKTMGTERSRGGKRGPQPGAERPEEPGATFSKKPPEGARAPRCLSRPTAPKSGACLARRRPPGSPCSIRDAPFHTGDDRFLARENFPNVLQPLPRMFAVQQAADFESQCPRRWDSRKRPSEGLPSAGWGRWRGRPIHLGLWVSGSVRRKVSGSHVSRSLHL

SEQ ID NO: 14960 - protein, 380 aa, Homo sapiens
VHQEIHTIEKTFECSHGKKSFCQESHFTEHHRTCTREKPCESSDCKKRFCHSSVLRVHQRTHTGEKPYECKECRKSFHVKPNLTKHQKTHIGEKPFKCTACGRTFFQQSTLNVHQRTHTGEKPCGCNECEKSFYNKDALIIHQRTHTGEKPYKCNECEKSYLKKSHLNIHLRNHTGKRPHVCNECGKAFSMKSTLTVHQRTHGEKPYKCNECRKSFYMKSALSQHQRIHIWEEHCECKECGKTYQRSHLAKHHRKYTKKPYECKQCGKTFQKSHLIEHQRTHPGEIPHECNKCGKSFCYKSPLTIHQRTHIEEKPYKCSKSVTYFCMKSHLTVHQRPHTRKNPFECNECRKMFYVKSNLINHQRTHTGEKPYEGNTCGKS

SEQ ID NO: 14961 - protein, 194 aa, Homo sapiens
MPAPRFLYSLRNYEPMKPLFFINYPVSDMELPVRSSTVTLLPAPLPRRGSVKTFLAPSKSYFPEEERALLKSSHAFCTGLWPWRRDFQLPQCHLALGLLPGERSVRLPRFLAVLKELSATASFTLASEAIPFLSSFPFPWNLLLPSVFQALPQKWQFKADFLLECTLSVKEAFHQECGAGVSLANGLNKGLRTG

SEQ ID NO: 14962 - protein, 2103 aa, Homo sapiens
MSVPGTPGAMEPAGEEERPPPAAEGEDDEEEVAAAAQTSGPAHGRSASSLEDADDQEEEMEAMVIGGGCCKEQELTYELQQGYRILGEFLQEKHRGLTAPFLQPLGGVATAEEEVAEGPRSGGRGGRAFPQQPGQGMCLLQMEEKFASGQYGGITEFVADFRLMLETCYRLHGVDHWISKQGQKLEMMLEQKLALLSRHLREKTTIAVTSRGYYGLEDEKGTACTSTRRRSTPRSLAGLTSGVFESIMVQVLRQEEQLRAKEEKRLREQERKEAEEASQKEIEEWERKLLAQAAPTCMETMWEIPAIGHFLCLAQQILNLPEIVFYELERCLLMPQCNAFLSKIMTSLLSPPHRRPTLHRRPTLPYRTWEAALRQKVQQWYTAVGQTENPDNCAEKLGLCPQFFKVLGEVNPLEEKPFHELPFYQKVWLLKGLCDFVYETQKEVQDAVLGQPIHECREVILGYDYLENAYVHFPQFCGADVRIYKQRPFQAPEFPIPPIKIQRVPRIKLEKLKCDYVSTSNGEHRCSRDSLPSSFKKEQENNFDPACCPAKMILDNHDISVEMGVKSNYEIRIRRPCEIKKTDCCKENLEKPRSPGEVTGFGEPLSPGEIRFIENQEKYGEASRIKIEPSPLKENTLKSCQIHVNGSHSDHPEINCHKVVRDILLEQSLQSHKKLKLTKMRAKKKKKKKKKLKDVLNENLQRKREGLHSLAFKSYKPEIQNKLLIIKKKAKHKKHKSGKKSVSKKAITKKRKTVIKSPTVPEFQLICTNLDELRELITKIENELKDLENSRKKSGKWYHRRQAVKELHSTLIRLLNELLPWEPKLMKAFQRNRSRLKKDYDDFRRQPDHDTFNRELWTTDEGEGDLGKDSPKGEISKSIDSTEPLDILEKDHFDSDDMKLSEIDFPMARSKLLKKELPSKDLPKTLLKTLKRQSKQTDYVDDSTKELSPRKKAKLSTNETTVENLESDVQIDCFSESKHTEPSFPESFASLDSVPVSTLQKGTKPIQALLAKNIGNKVTLTNQLPPSTGRNALAVEKPVLSPPEASPIKPALTCHTNTKGPLQMVYKMPCGQWLPIDLQNSSVKIQVQPMVDPKTGEKIMQQVLILPKNFVIQHKEGKAVAKEVPPLQQKGTEQHCSSFPQTTNINSSLASVFVNSPGTVSTQLPNTAFNKTITPLSNISSARPQPLSPVTSVSNLLTPSVKTSQSEAGKAKNAVSAATFSLPSASPTISSTGQPLSSTTTLNGSTNPGSSFNCFAQQTADSSEAKQELKTVCIRDSQSILVRTRGGNTGVVKVQTNPDQNSPNTVSSSSVFTFAPQLQAFLVPKSTTSSSAFSPVAGTTTTSSLSPFSQTPTSVSIPASFAPSMGKNLKLTLGHTTGSGDLGHVIDKTSHMPSSPLKSSICSSTLLPSTTSSSVSVISISAANFGQNNANIIHTPTKQQQVDYITKSYPVTRSEATAATNGDVISGTPVQKLMLVSAPSILSSGNGTAINMTPALTSTGVSAQKLVFINAPVPSGTSTPTLVAESLKQTLPPPLHKAYVKTPEQPQIVLIPSTVGTPIKINSSPAVSQIKDVKIGLNIGQAIVNTSGTVPAIPSINILQNVTPKGEDKSSKGYILPLSTSGNSVPVSSNFVSQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGISTTVPTNVNTNKPQTELSSLSTSPGKITNTSNFASLPNQQALVKTPSYSSAPGGTTIHTASAPSNVTSLVGSQFSEPCIQQKIVINTSTPLAPGTQIMINGTRFIVPPQGLGAGSHVLLISTNPKYGAPLVLNSGQGIQSTPIDNSAQKITLASNNSLSGQPLQHPLRSPTKFINSFGNASSIPTVHTSPQLINTTAKVPVPPPVPTVSLTSVIKSPATLLAKTSLVSAICPSNPPLPSSTSVFHLDPPVKKLLVSPEGAILNTINTPASKVSSLSPSLSQIVVSASRSPASVFPAFQSSGLEKPDRAAS

SEQ ID NO: 14963 - protein, 113 aa, Homo sapiens
MHTVPWGVDFALIAMKNFISQWSSFFRSGMGKSQTGYLPRVPREQPFAAGLWGLAAALSHLAVNAFSLLCPPLPKTSCSLNPHGDVESRKVHATVENVYISALNLPWVRVKWC

SEQ ID NO: 14964 - protein, 21 aa, Homo sapiens
RGADRERFARCVILVTQEADA

SEQ ID NO: 14965 - protein, 80 aa, Homo sapiens
MCLISLCVSFTSVNKREQNKPKILILLKKRLSGCFIKEARGTRLKGNQLAVTKARDDGGLAEDGDSGGGKVIRFWIYFEG

SEQ ID NO: 14966 - protein, 138 aa, Homo sapiens
AGGRPHQPASLPPGNPQLAALSLEQLKSQAPMDTKPAYQNPRRKAEHSVSVHLDEQDWNPTMHKSLLGNDQTQSEVQSGTLEAGVDRVISQTVDPKLNHILRPPVEGAIHEFLEARKKSSSASSPTRAQRARTLQLYP

SEQ ID NO: 14967 - protein, 27 aa, Homo sapiens
CWGFYYILYLLYIIYLYNIYILKTRSY

SEQ ID NO: 14968 - protein, 35 aa, Homo sapiens
IVLLLFICFLSKLNFTVLEKFPKSTFLCKIQHESL

SEQ ID NO: 14969 - protein, 189 aa, Homo sapiens
MCAKRLRGPFRIFLPLRKYSFFPSQVAQPFASAAVAQALLSSPGTNLQQTLVGGLRLRHGSVGGAQWVVKAACPWEPQDVACCGGFTVTARIAACVLLCLCEHMYTPSAHARMTFGTEHLLLWPAQRRADPRTAAPIRLHQGQLDPSRDPENLRAWAVGSCRAGVELHGSPVHLHMRAGQHISMFAGVA

SEQ ID NO: 14970 - protein, 1094 aa, Homo sapiens
MAARAPPAAPAAEEPGNPGGPPRRKKSRSGASGLRRAFSWLRGKRRKKKAAGAEGAEPAAPRAKKAEDKAKRAKGKGRGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 14971 - protein, 313 aa, Homo sapiens
MEYYYCPSLLKLLRYLWDQLKQCFSRQPTEPKDTDTLVHEAGSQYGTWTEQCQSGESLATESPDSSATSTRKQPPSSRLSSLSSQTEPTSAGDQYDCSRDQRSTSVDHSSTDLESTDGMEGPPPPDACPEKRVDDFSFIDQTSVLDSSALKTRVQLSKRSRRRAPISHSLRRSRFSESESRSPLEDETDNTWMFKDSTEEKSPRKEESDEEETASKAERTPVSHPQRMPAFPGMDPAVLKAQLHKRPEVDSPGETPSWAPQPKSPKSPFQPGVLGSRVLPSSMDKDERSDEPSPQWLKELKSKKRQSLYENQV

SEQ ID NO: 14972 - protein, 389 aa, Homo sapiens
CEKSTFFKHQKRTHTVEKTFECSHGKKSFCQESHFTEHHRTCTREKPCESNKYGKTFHQKRSFIHHQRTHTGEKPYECKECRKSFHVKPNLTKHQKTHIGEKPFKCTACGRTFFQQSTLNVHQGKHTEEKPYKYTECEKSFYKSVLIIHERTHTGEKPCGCNECEKSFEVLTTLVIHQRTHTGEKPYKCNECEKSYLNLKSHLNIHLRNHTGKRPHVCNECGKAFSMKSTLTVHQRTHMGKPYKCNECRKSFYMKSALSQHQRIHIYKKPYECKQCGKTFQKSHLIEHQRTHPGEIPHECNKCGKSFCYKSPLTIHQRTHIEEKPYKCSKSVTYFCMKSHLTVHQRPHTRKNPFECNECRKMFYVKSNLINHQRTHTGEKPYEGNTCGK

SEQ ID NO: 14973 - protein, 31 aa, Homo sapiens
MSEKTGEPAAENRDKEASVAGAQITLQTQTP

SEQ ID NO: 14974 - protein, 718 aa, Homo sapiens; identical to SEQ ID NO: 14863

SEQ ID NO: 14975 - protein, 1709 aa, Homo sapiens
MRAGWTPRGFSAFHASLLPGRHPYLAHLGPRDRGARIGSRAYSQGCCSCLWLTYKGKKEGSTKGELGPAAVTDLEIPSYSRGFLPCTPRFPTTWCRGPGCFCGTAVIAGNLGDLARIVGPSHHASQLLLLQEQDSGNHPTMAESLSEISDSLDVLEAGDEGKKKCKFKALKSFFVKKKEKEAEDTQEEEMLELSLSSSNINISSLQPVRENQPTKARAKSSMGSKALSHDSIFMLGPEPERSASKMFPSMDPQRGRPQQRSHISRTLPKPRSKVPGVVSGAMSGAVLQNVPTSAVWVAGPKITENPPSRRRRLSIIPPVIQPEIISKNLVEISLDDESPKNPQKKALPHKSLTATQSFSELSSGPDCSQSLTAFATLASTSSTQLPIGFSTPATTQGCLDSSAARHKMTLNPRKQKKNLQVIIRGLPVWFSHFQGILEGSLQCVTQTLETPNLDEPLPVEPKEEEPNLPLVSEEEKSITKPKEINEKKLGMDSADSSSQKQNNKTEMYDKKTTDQAPNTDASRSQGYPMSAAYGRRWRRKGASVSGLSGCEFKGRSLKQSSEGYGLGDRAGSSPTNKTARNVPFSHLSLEKDNMEQPTTSQPETTTPQGLLSDKDDMGRRNAGIDFGSRKASAAQPIPENMDNSMVSDPQPYHEDAASGAEKTEARASLSLMVESLSTTQEEAILSVAAEAQVFMNPSHIQLEDQEAFSFDLQKAQSKMESAQDVQTICKEKPSGNVHQTFTASVLGMTSTTAKGDVYAKTLPPRSLFQSSRKPDAEEVSSDSENIPEEGDGSEELAHGHSSQSLGKFEDEQEVFSESKSFVEDLSSSEEELDLRCLSQALEEPEDAEVFTESSSYVEKYNTSDDCSSSEEDLPLRHPAQALGKPKNQQEVSSASNNTPEEQNDFMQQLPSRCPSQPIMNPTVQQQVPTSSVGTSIKQSDSVEPIPPRHPFQPWVNPKVEQEVSSSPKSMAVEESISMKPLPPKLLCQPLMNPKVQQNMFSGSEDIAVERVISVEPLLPRYSPQSLTDPQIRQISESTAVEEGTYVEPLPPRCLSQPSERPKFLDSMSTSAEWSSPVAPTPSKYTSPPWVTPKFEELYQLSAHPESTTVEEDISKEQLLPRHLSQLTVGNKVQQLSSNFERAAIEADISGSPLPPQYATQFLKRSKVQEMTSRLEKMAVEGTSNKSPIPRRPTQSFVKFMAQQIFSESSALKRGSDVAPLPPNLPSKSLSKPEVKHQVFSDSGSANPKGGISSKMLPMKHPLQSLGRPEDPQKVFSYSERAPGKCSSFKEQLSPRQLSQALRKPEYEQKVSPVSASSPKEWRNSKKQLPPKHSSQASDRSKFQPQMSSKGPVNVPVKQSSGEKHLPSSSPFQQQVHSSSVNAAARRSVFESNSDNWFLGRDEAFAIKTKKFSQGSKNPIKSIPAPATKPGKFTIAPVRQTSTSGGIYSKKEDLESGDGNNNQHANLSNQDDVEKLFGVRLKRAPPSQKYKSEKQDNFTQLASVPSGPISSSVGRGHKIRSTSQGLLDAAGNLTKISYVADKQQSRPKSESMAKKQPACKTPGKPAGQQSDYAVSEPVWITMAKQKQKSFKAHISVKELKTKSNAGADAETKEPKYEGAGSANENQPKKMFTSSVHKQEKTAQMKPPKPTKSVGFEAQKILQVPAMEKETKRSSTLPAKFQNPVEPIEPVWFSLARKKAKAWSHMAEITQ

SEQ ID NO: 14976 - protein, 1806 aa, Homo sapiens; identical to SEQ ID NO: 14867

SEQ ID NO: 14977 - protein, 1409 aa, Homo sapiens
MESDRLIISLPRVKWTEAALTMASQLQEKCIAFIVDNFSKIIQSENFALLLQSQAMSSTADLLDTILKAIEENITTENSCSLLMALDTLLNSDSTKEMGFTCKIQALRDKLWIFLVQSFYAVRHTESWKLMSTDDQQKIQAAAFDKGDDRRLGKKPIFSSSQQRKQVSDSGDIKIKSWRGNNKKECWSYLSTNKKMKSDGLGASGHSSSTNRNSINKTLKQDDVKEKDGTKIASKITKELKTGGKNVSGKPKTVTKSKTENGDKARLENMSPRQVVERSATAAAAATGQKNLLNGKGVRNQEGQISGARPKVLTGNLNVQAKAKPLKKATGKDSPCLSIAGPSSRSTDSSMEFSISTECLDEPKENGSTEEEKPSGHKLSFCDSPGQMMKNSVDSVKNSTVAIKSRPVSRVTNGTSNKKSIHEQDTNVNNSVLKKVSGKGCSEPVPQAILKKRGTSNGCTAAQQRTKSTPSNLTKTQGSQGESPNSVKSSVSSRQSDENVAKLDHNTTTEKQAPKRKMVKQVHTALPKVNAKIVAMPKNLNQSKKGETLNNKDSKQKMPPGQVISKTQPSSQRPLKHETSTVQKSMFHDVRDNNNKDSVSEQKPHKPLINLASEISDAEALQSSCRPDPQKPLNDQEKEKLALECQNISKLDKSLKHELESKQICLDKSETKFPNHKETDDCDAANICCHSVGSDNVNSKFYSTTALKYMVSNPNENSLNSNPVCDLDSTSAGQIHLISDRENQVGRKDTNKQSSIKCVEDVSLCNPERTNGTLNSAQEDKKSKVPVEGLTIPSKLSDESAMDEDKHATADSDVSSKCFSGQLSEKNSPKNMETSESPESHETPETPFVGHWNLSTGVLHQRESPESDTGSATTSSDDIKPRSEDYDAGGSQDDDGSNDRGISKCGTMLCHDFLGRSSSDTSTPEELKIYDSNLRIEVKMKKQSNNDLFQVNSTSDDEIPRKRPEIWSRSAIVHSRERENIPRGSVQFAQEIDQVSSSADETEDERSEAENVAENFSISNPAPQQFQGIINLAFEDATENECREFSATKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGDIDDCDTLAQTRMYDHRPSKTLSPIYEMDVIEAFEQKVESETHVTDMDFEDDQHFAKQDWTLLKQLLSEQDSNLDVTNSVPEDLSLAQYLINQTLLLARDSSKPQGITHIDTLNRWSELTSPLDSSASITMASFSSEDCSPQGEWTILELETQH

SEQ ID NO: 14978 - protein, 122 aa, Homo sapiens
SHIMLNNGTKTDMLGLGTWKSPPGQVAEAVKVAINTVYRHIDCSHVHQNKDQEQLKEQVVRREWLFIISKPWGICHRKCLVRGSCRKVLSGLELDYLDLHLIHWPTGCHPGKEFSFLDESGN

SEQ ID NO: 14979 - protein, 1112 aa, Homo sapiens
  MOD_RES (1)..(1): Any amino acid
XYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPVVSPTGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 14980 - protein, 219 aa, Homo sapiens
LEKEEKNPNTEFYLKNLVLTTLNLFVGGTETVSTTLHYGFLLLMKHPEVEAKVHEIDRVIGKNQQPKFEDRAKTLYTEAVIHEIQRFGDLLPMGVSRRVKKDTKFRDFFLSKGIEVFPMLGSVLRDLRFFSNPRDFNPQHFLGEKGQFKKRDAFVPFSIRRRNCFREGLARMELFLYLTTIMQNFRFKSRQSPKDIVVSPKHVGFVTIPRNYTKCYLPC

SEQ ID NO: 14981 - protein, 43 aa, Homo sapiens
TDFLRTQPTRTRVNKQPLLLTLSLFKLSLQLDARITFGAESPG

SEQ ID NO: 14982 - protein, 124 aa, Homo sapiens
MTLNEHAAFKHLFNKAHLAPPLIHLTLSGHSTCFREHRVGGKVTDQQDPKAEEFFLVQNKMKSLPCLPLSTQTQQPSDFSIFSPPFPPFYSTKPPLSSWPVLNELLGTPPRWGGGRAEGLLTSQ

SEQ ID NO: 14983 - protein, 206 aa, Homo sapiens
LGISLGIDQDSAAFLLSTMAIAEVFRRIGAGFVLNREPIRVIYIELICVILLTVSLFAFTFAREFWGLMSCSVFFGFMVGTTGGTHIPLLAEDDVVGIEKMSSAAGVYIFIQSIAGLAGPPLAGLLVDQSKIYSRAFYSCAAGMALAAVCLALVRPCKMGLCQHHHSGETKVVSHRGKTLQDIPEDFLEMDLAKNEHRVHVQMEPV

SEQ ID NO: 14984 - protein, 193 aa, Homo sapiens
MNIFMTFVINVLRKNLFHGFMVITQAPVRILPSQERIRTPCHSPAILLSSCRVLSGNNCIMAALTSVIKRNLLFFRLDLFPLWLIFLYIVKMGDFPSAPTHLNTAAICTCLLPIPLGTHSDLLSVSCSWFHLFEKGPPLSYKHLVRQVHPLMNADTAAGGFVYTCKDKLRSLLFGEVKEDGNGCFICMSLEQC

SEQ ID NO: 14985 - protein, 32 aa, Homo sapiens
DTENSPGELSLSRKTEAQRGEAIHPQSHSRDG

SEQ ID NO: 14986 - protein, 304 aa, Homo sapiens
MVATGWARRSGLHPAPRPLRGAQEALAKNLWREERNRPLILSSLIIKKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQVKCHFNSGSSFLCTKTIICDLISKNKDI

SEQ ID NO: 14987 - protein, 133 aa, Homo sapiens
MGQDAGRLQRRSRVGFGENGACRKERQKLALEGSKKGPWKGRSGDRKGNSKGQEELGRGARVNTEWPMPRMRDWKERRGPSREEAHKSLGRQGMGLQRGEGVRAVAARVLCHPCPLSRGLQHNRGDRFVWGQV

SEQ ID NO: 14988 - protein, 84 aa, Homo sapiens
MVLASFTQNMNIKCCEFVCQVVQKYIINNLVKKRNCEPSWSVYSILCLYVIFSSNRFIIIGFTKRSRKKSEGEIASTALQATSG

SEQ ID NO: 14989 - protein, 51 aa, Homo sapiens
LKPGFFLSFFISMTYLFSFFFFGKSFRSLLGEGFSLCLSLSLTHTHTHTHS

SEQ ID NO: 14990 - protein, 145 aa, Homo sapiens; identical to SEQ ID NO: 14859

SEQ ID NO: 14991 - protein, 1047 aa, Homo sapiens
MAHCGQLTNWLCLAWERKESPDFLSIFLRYIDLTPKLHKICSDKTITQKTHCLLPLISSALSSIVLIQGWWQKTAHKYAYKGAKHIEQQNPQSRHRPRPAGALPQISRDSRQRCLLLRFLVRPRGFSFSFAEPAAAFPGATAMAASLSERLFSLELLVDWVRLEARLLPSPAAAVEQEEEEEEKEQGEASSPRGLCPAVAFRLLDFPTLLVYPPDGPGAPAAEPWPGVIRFGRGKSCLFRLQPATLHCRLLRTPLATLLLQLPPGRPTPTPQLLGACDISLATAAHRVVGPAASGCSHRHRGRFPLHNRVGERTGDIALAYRLTDLGSRLLSQLERPLTFTRTGGGAEVSPQTQQERQQLQQPASQPSPKEADKPLGELEIPEAQKDLKEMVKSKAECDNVGSVENGKTNSVVTCSGAGNGRNVSSLNEEVTELDMETNIFCPPPLYYTNLTQEKPPPAQAKITIEPQMNAPEEMDDASPEKKRVNPPAHRSCLKHPSSAAHEHPPMLVNPPHIQNIGATNQTCQTEQNRINTIRQLPLLNALLVELSLLYDQPVTSPAHIHPHLAWLYRTEDKKSPESSAKSTCRSEAKKDKRSVGGCEKSVSLQYKKNQIENYKEDKYSEKSSGALHKRVPKGRLLYGLTNTLRLRLKLTNPDMLVVHEKRELYRKRQSQMLGTKFRIPSSKVKLLSSAEQSQKPQLPEDKYLDSDASFTENSDTSRQISGVFDEPSTSKETKLKYATEKKTVDCSKNRINNVSLEEVVSPANSIIPERLTPTNILGGNVEMKIQSPCVFQQDAVVDRIVDKEIDIRQVKTTDNDILMADISDKRTGKNSCYENISELKYSDDLSSPCYSEDFCTSEDTSRSFKAHDSSSRTENPKHSQYTSKSSDTGVSKKKNSSDRSSILSPPFSAGSPVHSYRKFHISKTQDKSLEEASSISASDLSSTHWTEQKENQIDQNSMHNSEITKRAQDISVKTRSSWKSLEKSQSPQTSQVSSYLPSNVSELNVLDSSTSDHFEEGNDDVGSLNISKQCKDICELVINKLPGYTM

SEQ ID NO: 14992 - protein, 186 aa, Homo sapiens
RSLLKELENTKDHTLLLEKRLKKLSREGSSHHLPRQVRPGPVYKPAPARNHRPRGGRGKASPTSFHVSPRAPLAPLASMPSSVPKTSIESLGSPSSLSSSQASEPLCPLKHPSHRPPASTLSPNLTSSTESLGLLSRETPHAGRRRQGSRFPQPGCANAAGRTRHQNPRHSHGHRISDIHEQLGIS

SEQ ID NO: 14993 - protein, 134 aa, Homo sapiens
MREPIYIHSTMVFLPWELHTKKGKMALLASNGCFIRCNEAGDIEAKSKTAGEEEMIKIRSCAERETKKKDDIPEEDKGNVKQCEINYVKKFQSFQEHKLKISKEDSKILKKAQKDGFLQETLLDRVAVIACLHL

SEQ ID NO: 14994 - protein, 148 aa, Homo sapiens
MEHMLLANHTDKATFTGTQRQRSCSGASVSQPRPLRGKLVGYWDPHSRLLSRGRALGSVSAPSTPRGRGWKATFDGCILHDDLLTKVHGFQSLIGLQQHLACGDSGSLMKNCHDVRKSLSERGWGAACWGGGGVASREKLHPLAESGT

SEQ ID NO: 14995 - protein, 431 aa, Homo sapiens
MWPQPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEREEKIQEQEEKIREQEEKIREQEEMMQEQEEKMGEQEEKMQEQEKMRRQEEKIREQEEKIREQKEKIREQEEKIWEQEEKIREQEEMMQEQEEKMWEQEEKMCEQEEKMQEQEEKMRRQEEKMREQEVRLRQQEEKMQEH

SEQ ID NO: 14996 - protein, 566 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTVTNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 14997 - protein, 60 aa, Homo sapiens
KGWVSHLFLAPTNFEEFTAPATPPHCSQCLRSNCSTWATAAIIERSLQVPFLYLSTPGGH

SEQ ID NO: 14998 - protein, 132 aa, Homo sapiens
MSQPWLYSQCIISGKPSEEAAGENGSISAALRPLLLVADVPVLGYLCPSSVSSGVCEAKLLGWGLGGVSAAPEAKTKAEAEAEAEATLVRRKLQVEKLVDRDLDLTVILMVPMPSARRPPALATTGSCSPPG

SEQ ID NO: 14999 - protein, 464 aa, Homo sapiens
MRRHSETDVEEQTQELKTITQLQEQCRALQIQGVKENMDQNKATLALLRSNIRRGAQDWALAKKYDQWTISKACGKNLPLRLAHCRSTMEVVREKLRKYVFDRVNMHNLLIHLVRRRGQKLESMQLELDSLRSQPDASKEELRLLQIIRQLENNIEKTMIKIITSQNIHLLYLDLLDYLKTVLAGYPIELDKLQNLVVNYCSELSDMKIMSQDAMMITDEVKRNMRQREASFIEERRARENRLNQQKKLIDKIHTKETSEKYRRGQMDLDFPSNLMSTETLKLRRKETSTAEMEYQSGVTAVVEKVKSAVRCSHVWDITSRFLAQRNTEENLELQMEDCEEWRVQLKALVKQLELEEAVLKFRQKPSSISFKSVEKKMTDMLKEEEERLQLAHSNMTKGQELLLTIQMGIDNLYVRLMGINLPATQVPGVRLSCHTPGPWAGPEGRQAQRLIEGKLKAAKKKKK

SEQ ID NO: 15000 - protein, 126 aa, Homo sapiens
SGSPAGLLKGDSKKPSQRRVKRQPYSTTKVTSGSTFNENTRRYAVHTNQCRRPHGSRVKKKRYPQEDDFHHTVFSNLERLDKLQPTLEASEESLVHKDRGDGERPVNARVVQVAPLRLESRISIGE

SEQ ID NO: 15001 - protein, 437 aa, Homo sapiens
MWPQPHLPTHPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVQTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEREEKIQEQEEKIREQEEKIREQEEMMQEQEEKMGEQEEKMQEQEKMRRQEEKIREQEEKIREQKEKIREQEEKIWEQEEKIREQEEMMQEQEEKMWEQEEKMCEQEEKMQEQEEKMRRQEEKMREQEVRLRQQEEKMQEH

SEQ ID NO: 15002 - protein, 198 aa, Homo sapiens
  MOD_RES (1)..(1): Any amino acid
XTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKPGQQSETLSLKKK

SEQ ID NO: 15003 - protein, 1395 aa, Homo sapiens; identical to SEQ ID NO: 14826

SEQ ID NO: 15004 - protein, 121 aa, Homo sapiens
MEFVLSWVFLVAILKGVQCEVQLVQSGGGLVHPGGSLRLSCAGSGFTFSSYAMHWVRQAPGKGLEWVSAIGTGGGTYYADSVKGRFTISRDNAKNSLYLQMNSLRAEDMAVYYCARDTVRG

SEQ ID NO: 15005 - protein, 258 aa, Homo sapiens
RSLLKELENTKDHTLLLEKRLKKLSREGSSHHLPRQVRPGPVYKPAPARNHRPRGGRGKASPTSFHVSPRAPLAPLASMPSSVPKTSIESLGSPSSLSSSQASEPLCPLKHPSHRPPASTLSPNLTSSTESLGYLSSLSSSQPPEPLRPLECPSHKPCGRSLPRRRNPGWVSWSDSMQADSETDAIICPMCKAPERSCPHTWWVPSSPRVIRGVGRCSDPNLGLSWRQEAARAWCHCTSSQYPFKHPNLPTHLPKASF

SEQ ID NO: 15006 - protein, 750 aa, Homo sapiens
DYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKDSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLIAARCVVPALHLVNTEVDFGHCFLKYPYEKTLQLADQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHF

SEQ ID NO: 15007 - protein, 97 aa, Homo sapiens
EVQLVQSGGGLVQPGGSLRLSCAGSGFTFSSYAMHWVRQAPGKGLEWVSAIGTGGGTYYADSVKGRFTISRDNAKNSLYLQMNSLRAEDMAVYYCAR

SEQ ID NO: 15008 - protein, 237 aa, Homo sapiens
  MOD_RES (1)..(1): Any amino acid
XTYHRIPMPDFCAPREEDFDQLLEALRAALSKDPGTGFVFSCLSGQGRTTTAMVVAVLAFWHIQGFPEVGEEELVSVPDAKFTKGEFQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 15009 - protein, 215 aa, Homo sapiens
YGVCSVGLEWLAYLLVPYSLGASATSLLGLLGLWLPRPVPLVAGAGVHLLLTFILFFWAPVPRVLQHSWILYVAAALWVVGSSLNKTGLSTLLGILYEDKERQDFIFTIYHWWQAVAIFTVYLGSSLHMKAKLALLLVTLVAATVSYLRMEQKLRRGVAPRQPRIPRPQHKVRGYRYLEEDNSDESDAEGDLGDGEEAEAEAPPAGPRPGPEPAG

SEQ ID NO: 15010 - protein, 1275 aa, Homo sapiens
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLQDLLKNEQNQEEMTLDLLWDLSCHSSVSFPSTLSGTSFHFLSRTSLHSVEDNSSMDVKSMWDDIRLHLRRFLVSKLQSHNEINNSQQKILLKKQCLQQLLFLYPESEVIIKYQNIQNKLLANLLWNCFPSYNRDSNLDVIAHGYQSTMLKLYSVIKEDFNTLCEILAPSSMVKFIKETYLDTVTEEMAKFLENFCELQFRENAVRVVKTSKSSSKHRGAVHALVTTECPQKGRNFSLPLDKVEFLSQLIKSFMKLEKGVQELFDEILLSLKITRDTSGILEKSDREVVMEKPRANETNIPSEQSLPGKEATLLDFGWRSAFKEVSLPMAHCVVTAIEGFSTKILQQEQNERSSAVSYAMNLVNVQQVWQDSHMFPEEEQPKKIGKFCSDIMEKLDTMLPLALACRDDSFQEIRANLVEACCKVATAVLQRLQERAKEVPSKAPLKNLHTYLSTAVYVFQHFKRYDNLMKEMTKKPIFLVLVQRYQEFINTLQFQVTNYCVRVCATSILQDAESHHWDDYKAFYEGERCSFSIQMWHYFCWSLHYDLWTILPPKLAQEILVEVLEKSLSLLASRYARAHPSRKRTPQLRLDVTTILICTENMLWSVCTSVQKLLNPHQHTDDKIFKIHTHCNNLFTTLVILTSPLTELYKTFQHGLDESASDSLKSFFKQPLYWVSCISHFYPSLLRTPSAGGLKAEGQLKLLLSQPRCNWNLLLETLLHHDGLLLRILLKSSKQVSDTENNLNQGPSLMEAIFKILYHCSFSPQTFANVFVSYMEEEQLWDFLYNIPVSTCVEYELEVIRCLRLALTDAIKDTVQQIVSVMSSRRNCETNLNKHIVPDCLLESMPKEWNYSPKETNRKESCKSFTRLTAQAVSIVISKLPTVIACLPPPVKYFFFLSERKMSKKFVELKKAGLLVWNLIVIICRIFEDGNTVELLTGASLDRWSKEKLGLICMCLKSIMGDQTSIHNQMIQKVIQSIEQQKPNWIERQLLKARKLSTECAFMTIEKSTALQEGDVALELTEQKINTMVLDLCHKPGGREYLRQIYHIMQLNEEYLKEQLFSMNSSEEKPLPIRPLKTTLRSIEDQPSAFNPFHVYKAFSENMLDQSAITKWNWNWAKLLPNYLRLDKMTFSVLLKNRWEMKKDETLEEEEKAILEHLKQICTPQNSSASDNIEEQ

SEQ ID NO: 15011 - protein, 43 aa, Homo sapiens
RLRSRPQAGGAGSAAACGPGQGRFRRAAPRPSSSRVCGQRTSR

SEQ ID NO: 15012 - protein, 194 aa, Homo sapiens
MVTWSHSNSNKELKQENSALAEQLQVVLIDKAGMQCDLEELKKKLELTELTLQQLSSWCEAPDANQQLQQPTDERAQLEAHLGQVMEWLKYLQMEREQYAEYLHGESAMWWQRMREMSEQVHTLREERVHSMSRVQELETILAELRNQLNPCPRSLQQGPPKWSRSYKQRLSTCGRSWRIWQDSFKPKWKKMRA

SEQ ID NO: 15013 - protein, 292 aa, Homo sapiens
MMFYWLLSIVGRQRASPGWQNWSSARNSASAAEARSMALPTQAQVVVCGGGITGTSVAHHQSKMGWKDIVLLEQGRLAAGSTRFCAGILSTARHLTIEQKMADYSNKLYHQLEQETGIRTGYTRTGSIFLAQTQDRLISLKRINAGLNVIGIPSEIISPKKVAELHHLLNVHDLVGAMHVPEDAVVSSADVALALASAASQNGVQIYDRTSVLQVMGKKGQVTGVETDKGQIECQYFVNCAGQLLWMLMEEFIFGTGRVASCLGALRRTQNQFSLRARTSWRFRIYRGLGSL

SEQ ID NO: 15014 - protein, 662 aa, Homo sapiens; identical to SEQ ID NO: 14932

SEQ ID NO: 15015 - protein, 98 aa, Homo sapiens
VCGSTQEKTVFRLEAMLERTAGVQSKEAALEEEAVLKVEDIMAEVEVVVEVEVVVEVEPDVGWQKEGQRAQPGPGPSTPGPSMDSLEVLHLELGSVNA

SEQ ID NO: 15016 - protein, 152 aa, Homo sapiens
MLFSFEHKAVALSATRRATPRPQPWVLGLQGRGGEGDARTCGAGRERGLPGPALDTEPRWDPRRLCEALRAPGRRLEGAGQPPATSGGPATSGRSKEPWGHISGCGDPPGAFRGSGRICQGTSGARPCFCRAPGYPWMAALCPRRRPGRHSG

SEQ ID NO: 15017 - protein, 146 aa, Homo sapiens
PGPPGRPGKPGFPKPGGPGGPAIPGAPGRPFVPGIPGWPGAPAAPGFPMPSGPRSPGGPWGPGGPIGPISPGPGIPGGPGGPRGPGRPAGPTSPFGPYGPLSPGFPGSPGTPGFPTADGPGGPGNPGSPWSPGLPYPRGPAGPGGP

SEQ ID NO: 15018 - protein, 27 aa, Homo sapiens
VPPLHSSLGDRARFLRPCLKKKTKKKR

SEQ ID NO: 15019 - protein, 1020 aa, Homo sapiens
QLRRSELEHSVDLEEALGRLEAAEERSTGLCQVNALLREQLEHMKKANDALGRELAGMTGSVQRLQGELELRRWAQRQEPSRTRSGGLGQPRDLLLLWRQAVVLGTDLAELRVATERGLADLQADTARTARRLHTACLNLDSNLRLSASSTASTLGQQLRDKAGEMLQLQGRWDAEKVALQARLSEQTLLVEKLTEQNEQKAKTIAALRTDLQNLVGGQDGGGCVAGVCHPCSGVSPATGSLVAQEDARCLELAGSSITELGEPRRPLRSPQRATSPHQGASPPHICSPATLDPALQAMRAAIERRWRREQELCLQLKSSQALVASLQEQLSESRRELWAAQKLQQERAREQAREREALRGQLEAQRLEVQQCRASCKLLGREKAALEMVVEELKGKADAADAEKQGLEAEAAELQRSLLLQAERREELALRRERSCRALETSQGRLQQLEEKVSGLREELASVREALSTAQLQRDVVESEREGLRSALARAECSNADLELLVRRLKSEGVEQRDSLAAMAALMEGLAQDKSALNHLALQLEQERDQLREQRKTLEQERARAGEQLAQAEQQLALERAERRGLQQACGRLEQRQEQLEGQAALLGREKAQLQEQVGQVTCQKQALEEQLAQSLQDQEAQMGTLQQALQGKDALSEERAQLLAKQEALERQGRLAAEEAADLRVERDSLESSLLEAQQLATKLQEQLEEEARSAGLARQALQVEMEQLQSDWEVQEMKLRQDTVRLQRQVAQQEREAQRALESQALAHREALAQLQREKETLSLTLAEEKEVARCQLEQEKELVTKSAAEREALKGEIQSLKQERDESLLQLEHKMQQALSLKETERSLLSEELSRARRTLERVQQEAQSQQEQAQATISATTEELKALQAQFEDAITAHQRETTALRESLQDLAAERGDVEREAERLRAQLTVAQEGLAALRQELQGVEESREGLHREAQEARRALSDEAREKDVLLLFNSELRATICRAEQEKASFKRSKEEKEQKLLILEEAQAALQQ

SEQ ID NO: 15020 - protein, 464 aa, Homo sapiens
  MOD_RES (1)..(1): Any amino acid
XALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGES

SEQ ID NO: 15021 - protein, 1302 aa, Homo sapiens
  MOD_RES (1)..(1): Any amino acid
XPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQVRPVFCWGVRHGKILGIHRGLEWVLWEYNWSVGESW

SEQ ID NO: 15022 - protein, 108 aa, Homo sapiens
PSCVPVLKGAHAADSSRSKWPALMGTGRKSFGAFLFHHSFSWGWKLISISFGDLNPFPVRQIRNRRAYHLEKVRLELTELEAIREDFLHERDTSPDKGELVSDEEEDT

SEQ ID NO: 15023 - protein, 1309 aa, Homo sapiens
MLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 15024 - protein, 152 aa, Homo sapiens
EGSMDSLYEPIPEQQANQENMSSRTDSPIPPFGESEQTPNNLFVGVSNLENAKPKKRKLFRRFMSENKIFEGKTVNDKIWQEHSKHKNDSHIRRPCQLKDLNENDFLSNNIHTYQGKTLQGTSYQVTSECWSPFHYQRHVETTVDELAQEFM

SEQ ID NO: 15025 - protein, 279 aa, Homo sapiens
MPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNWLKAQALFKSRELVAEKQLTKPQELKLDMNGSDSGPSLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRPGISTKICFLSNHFFILFS

SEQ ID NO: 15026 - protein, 132 aa, Homo sapiens
MSFEYRHYKREAKICTCRGGWAHVLLCIGVSQGACAEHLPHRPAVEKDVPGAGEVLFMCSWRIFPVASASPSSSISGLAGHSVFLVPGLAAHPGSHSDQPPGVPSRRKSRLERWSPSVSRSTSPPTEAPFCL

SEQ ID NO: 15027 - protein, 417 aa, Homo sapiens
MKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQSINIMELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 15028 - protein, 208 aa, Homo sapiens
ITPTPPPPPRSREKESPRVAARVVVPVRSRERVLTSMGLTGVEGRGCRYSGCKMWPVRAVSIFSTLIGRRLAWRRGSEGGTACTKGLVLPAGDEPGPGPELFPESALVQAGSAPPPPPPPPPPPLCLLLLRAESEGAVLMTHPRAWEQRGGGLREARGGLGAARSPREQEQREEEELARRPRAPSAPSRRLEPDASNPGWPAAEPWPG

SEQ ID NO: 15029 - protein, 178 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADE

SEQ ID NO: 15030 - protein, 68 aa, Homo sapiens
VAAVTERTSGNLSASSVKCDHKYRVPGSARDRSHYVDRAGLKLLASSSPPAATSQQHWNDRRTPLNIH

SEQ ID NO: 15031 - protein, 517 aa, Homo sapiens
MLESIRVTEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQSINIMELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 15032 - protein, 145 aa, Homo sapiens; identical to SEQ ID NO: 14859

SEQ ID NO: 15033 - protein, 564 aa, Homo sapiens
MLMWPQPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEREEKIQEQEEKIREQEEKMRRQEEMMWEKEEKMRRQEEMMWEKEEKIRELEEKMHEQEKIREQEEKRQEEEKIREQEKRQEQEAKMWRQEEKIREQEEKIREQEEMMQEQEEKMGEQEEKMWEQEEEMQEQEEKMRRQEEKIREQEKKIREQEEKIREQEEMMQEQEEKMGEQEGKMCEQEAKMQEQEEKMRRQEEKIREQEKKIREQEEKIREQEEMMQEQEEKMWEQEEKMCEQEEKMQEQEEKMRRQEEKMREQEVRLRQQEEKMQEH

SEQ ID NO: 15034 - protein, 247 aa, Homo sapiens
GIVGGHNAPPGKWPWQVSLRVYSYHWASWAHICGGSLIHPQWVLTAAHCIFWKDTDPSIYRIHAGDVYLYGGRGLLNVSRIIVHPNYVTAGLGADVALLQLEPHDLSNVRTVKLSPVSLELTPKDQCWVTGWGAIRMKESLPPPYRLQQASVQVLENAVCEQPYRNASGHTGDRQLILDDMLCAGSEGRDSCYGDSGGPLVCRLRGSWRLVGVVSWGYGCTLRDFPGVYTHVQIYVLWILQQVGELP

SEQ ID NO: 15035 - protein, 179 aa, Homo sapiens
MGSWHWEWYGAPTSTLSLGCLLLPGEKWTFLILPSHYGTTTHAHSLQGCVERQWQDSKQLAISPGPTLLRSEYVGSLSPVCSSLTQVHRVPWGQHRACPVMLLVFTKWLQRYLHFEKPAEPASVGQDPDFFGKSEGERATCLLSRSCLYLASVCNLRENDSCMGRSGGTGKSDLPGSCR

SEQ ID NO: 15036 - protein, 27 aa, Homo sapiens
FPSFDISFFLFIYLFNSSHSPDRVSLC

SEQ ID NO: 15037 - protein, 386 aa, Homo sapiens
MGVGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 15038 - protein, 130 aa, Homo sapiens
WKPQHSFFFLLLLWLPDTTGEIVMTQSPATLSLSPGERATLSCRASQSVSSSYLSWYQQKPGQAPRLLIYGASTRATGIPARFSGSGSGTDFTLTISSLQPEDFAVYYCQQDYNLPPTVIQHETKTSTRP

SEQ ID NO: 15039 - protein, 231 aa, Homo sapiens
MAKWVPALLLRRVPLFSLRFRPASSTFLPVLAATEPAVSVPSGDLSMPVKTRAEGEDDGFGEAGDPRRLLERPWRFRGCLPGKGNRDVGFEGTEGPTSTRPEWVWSCRCCLGCRASTRERVTSPVRAAGPQPRFTDRETEAAAGTLAHMGFAPPTSFSHFTDQELRDCSSLECLGVVEGDPHVLCSTLSLSRPSPSATLTLLLASSCLLAPAPPSFILLLFTLIAPDLPHS

SEQ ID NO: 15040 - protein, 91 aa, Homo sapiens
MEIAHYAKVFTADGHLGCYILATMNYHSAKHCGSCLQSQLCKRLKQEDRLSPGFQGQLGQHSETSSLKTVIGPLAPSCHLADMKNWRWQQW

SEQ ID NO: 15041 - protein, 163 aa, Homo sapiens
MCTVGGNVSEDACYGEPLEFPENTKNRATLGSSSPTAGHTPQRKEIRISKMYLHIPIHCSTTYNGRDLESTSVPINRRTDKKNVVRRHSGYCSAREERNPVISAAWMSLEELGKSARCRKTNTPGSHTSVGAKKAELKAVVMDCWLPESGEGVRVRARRENKL

SEQ ID NO: 15042 - protein, 162 aa, Homo sapiens
HKNTYIRTYIHICVYIRTYIHICVYAYVYTYMCVCVRIYIYVCMRTYIHICVYAYVYKYMCVCVRIYIHTCMYIYTYICMYIMCIYVRTYIYVYICTCIHICVYMYVHIYGYICTYIHRYGYICTYIHIYVYTCKYIHIYGYTCMYIHIYGYTYMYMYVCIF

SEQ ID NO: 15043 - protein, 114 aa, Homo sapiens
VLCLFFFFFLRRSLALLPRLECSGAIWAHCKLCLPGSRHSPASPSRVAGTTGTCHHAQLIFVFLVETGFHHIGQAGLELLTSGDPPALASQSAGITGMSHRAQPMWDLSGLIRL

SEQ ID NO: 15044 - protein, 90 aa, Homo sapiens
GGAKEEPKRRSARLSAKPPAKVEAKPKKAAAKDKSSDKKVQTKGKRGAKGKQTEVANQETKEDLPAENGETKTEESPASDEAGEKEAKSD

SEQ ID NO: 15045 - protein, 341 aa, Homo sapiens
  MOD_RES (1)..(1): Any amino acid
XAERFVPALSLGDWPRSPLAPRCWARPGPVSFPGLRFSPGTAALSAPATPSPGSPLRPRASPQPPAGGPGPGSAGGDPAPGGAGPMELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCN

SEQ ID NO: 15046 - protein, 141 aa, Homo sapiens
MLHSMRFLRTDSASADPGNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYCDESRLSNLLRRITREDDRD

SEQ ID NO: 15047 - protein, 106 aa, Homo sapiens [sequence omitted]

SEQ ID NO: 15048 - protein, 107 aa, Homo sapiens
MGRDATRIGERLQGEGNFQLNFVTISSKLKVSWTESGKGVTQERRYSTETGAGGEAQILKAACFLSGEAWSLRQVFSPAHRLPGNKLSAIGVHSESETSLSGCVGAG

SEQ ID NO: 15049 - protein, 117 aa, Homo sapiens
  MOD_RES (1)..(1): Any amino acid
XAGRRGRTTPQTLEFPGAQTLAISRGCRCASPRRGRGGWWSLTARVLYITNKAGTFPFLLGKYLEEKLLGNWVETRFRHIDWAGLELLSSSNRPSLTSQSARITGVNHRARPYFLSK

SEQ ID NO: 15050 - protein, 79 aa, Homo sapiens; identical to SEQ ID NO: 14911

SEQ ID NO: 15051 - protein, 260 aa, Homo sapiens
VCGSTQEKTVFRLEAMLERTAGVQSKEAALEEEAVLKVEDIMAEVEVVVEVEPDVGWQKEGQRAQPGPGPSTPGPSMDSLEVLHLELGSVNAPGHRATNKQKKKKERKENPNLWKPGSTLQKPPQLWRCLLARQNEMSAWVGKHAEVLLCYVMDLQVEELSHPGYRWQMISFHPNLYFHSEIIMKEHCVGILGYRVSHSTAVQRFWDHEGQASSCRQYTSYLSSFSCLAEHDCPGFGRIAESTRSSARACGSIFCSTTQG

SEQ ID NO: 15052 - protein, 95 aa, Homo sapiens
SLPEALVQPGGSLRLSCAASGFTCSNAWMSWVRQAPGKGLEWVGRIKSKANGGTTDYAAPVKGRFTISRVDSKNTLYLQMNSLKTEDTAVYYCTT

SEQ ID NO: 15053 - protein, 218 aa, Homo sapiens
  MOD_RES (1)..(1): Any amino acid
XHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHA

SEQ ID NO: 15054 - protein, 39 aa, Homo sapiens
QKGGVEGKWQADAVLSWCPLAFAVVPSKQLSELWYICSD

SEQ ID NO: 15055 - protein, 718 aa, Homo sapiens; identical to SEQ ID NO: 14863

SEQ ID NO: 15056 - protein, 178 aa, Homo sapiens
ELSSQKTGGNLDRHTASKPTALLQPGPGWQRGAACCLQILPESRVCFPTGLPLARKVTKLSWVGYKLQGRELQWPVYREELELERLLWRRRPGDRDLRRTGDLRLGERDLLLIRGGDLRHIGGGGNILLGGLNLLGGGLGQGASTAVAVISWPSICPPPSMCFSAFSASSGFSNSTYA

SEQ ID NO: 15057 - protein, 570 aa, Homo sapiens
MLMWPQPHLPTHPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVQTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEREEKIQEQEEKIREQEEKMRRQEEMMWEKEEKMRRQEEMMWEKEEKIRELEEKMHEQEKIREQEEKRQEEEKIREQEKRQEQEAKMWRQEEKIREQEEKIREQEEMMQEQEEKMGEQEEKMWEQEEEMQEQEEKMRRQEEKIREQEKKIREQEEKIREQEEMMQEQEEKMGEQEGKMCEQEAKMQEQEEKMRRQEEKIREQEKKIREQEEKIREQEEMMQEQEEKMWEQEEKMCEQEEKMQEQEEKMRRQEEKMREQEVRLRQQEEKMQEH

SEQ ID NO: 15058 - protein, 132 aa, Homo sapiens
FTQTYRRSRQHEQLPGQRHMDLLTGYSKLIQSRLKLLLHLGSQPPVGKTFFFSCWCHPLFHGSKTTPNVWYKFSETALSILNSCQASQLGVRKMPGDMSSSPRVREFSALVAIKEKIHILPTNAKVGSKFGS

SEQ ID NO: 15059 - protein, 148 aa, Homo sapiens [sequence omitted]

SEQ ID NO: 15060 - protein, 532 aa, Homo sapiens
MDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSADHPPKLYHSALNRQKEQQRIERENLALLKRLEAVKPTVGMKRSEQLMDYHRNMGYLNSSPLSRRARSTLGQYSPLRASRTSSATSGLSCRSERSAVDPSSGHPRRRPKPPNVRTAWL

SEQ ID NO: 15061 - protein, 694 aa, Homo sapiens
MDLHKQWENTETNWHKEKMELLDQFDNERKEWESQWKIMQKKIEELCREVKLWRKININESAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGSISQSNDVSGIWKTNAHMPVPMENVPDNPTKKSTTGLVRQMQGHLSPRSYRNMLHEHDWRPSNLSGRPRSADPRSNYGVVEKLLKTYETATESALQNSKCFQDNWTKCNSDVSGGATLSQHLEMLQMEQQFQQKTAVWGGQEVKQGIDPKKITEESMSVNASHGKGFSRPARPANRRLPSRWASRSPSAPPALRRTTHNYTISLRSEALMV

SEQ ID NO: 15062 - protein, 148 aa, Homo sapiens [sequence omitted]

SEQ ID NO: 15063 - protein, 101 aa, Homo sapiens [sequence omitted]

SEQ ID NO: 15064 - protein, 70 aa, Homo sapiens
MSLPIGIYRRAVSYDDTLEDPAPMTPPPSDMGSVPWKPVIPERKYQHLAKVEEGEASLPSPAMTLSSAID

SEQ ID NO: 15065 - protein, 1233 aa, Homo sapiens
MGTRAFSHDSIFIPDGGAESEQTVQAMSQDNILGKVKTLQQQLGKNIKFGQRSPNAIPMNKANSGEASLEEDLFLTSPMEIVTQQDIVLSDAENKSSDTPSSLSPLNLPGAGSEMEEKVAPVKPSRPKRHFSSAGTIESVNLDAIPLAIARLDNSAAKHKLAVKPKKQRVSKKHRRLAQDPQHEQGGLESRPCLDQNGHPGEDKPTWHEEEPNPLDSEEERRRQEDYWRELEAKCKRQKAEAAEKRRLEEQRLQALERRLWEENRRQELLEEEGEGQEPPLEAERAPREEQQRSLEAPGWEDAERREREERERLEAEEERRRLQAQAQAEERRRLEEDARLEERRRQEEEEGRCAEELKRQEEEEAEGWEELEQQEAEVQGPPEALEETGEGRRGAEEEDLGEEEEEGQAHLEDWRGQLSELLNDFEERLEDQERLKPEGQREHSEEPGICEEQNPEAERRREQQGRSGDFQGADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPRQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 15066 - protein, 65 aa, Homo sapiens
MSLPIGIYRRAVSYDDTLEDPAPMTPPPSDMGSVPWKPVIPERKYQHLAKVEEGEASLPSPAMTL

SEQ ID NO: 15067 - protein, 95 aa, Homo sapiens
MSLPIGIYRRAVSYDDTLEDPAPMTPPPSDMGSVPWKPVIPERKYQHLAKVEEGEASLPSPAMTLSSAIDSVDKVPVVKAKATHVIMNSLITKQT

SEQ ID NO: 15068 - protein, 709 aa, Homo sapiens; identical to SEQ ID NO: 14931

SEQ ID NO: 15069 - protein, 55 aa, Homo sapiens
EVSNPFDGLEELGKTLEDYTREFINRITQSELPAKMWDWFSETFRKVKEKLKTDS

SEQ ID NO: 15070 - protein, 75 aa, Homo sapiens
MYPICTVVVDGLPSESSSSSYPGPVSVSEMSLLHALGPVQTWLGQELEKCGIDAMIYTRYVLSLLLHDSYDYDLQ

SEQ ID NO: 15071 - protein, 305 aa, Homo sapiens; identical to SEQ ID NO: 14824

SEQ ID NO: 15072 - protein, 709 aa, Homo sapiens; identical to SEQ ID NO: 14931

SEQ ID NO: 15073 - protein, 260 aa, Homo sapiens
MDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERPEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 15074 - protein, 260 aa, Homo sapiens; identical to SEQ ID NO: 15073

SEQ ID NO: 15075 - protein, 1275 aa, Homo sapiens; identical to SEQ ID NO: 15010

SEQ ID NO: 15076 - protein, 95 aa, Homo sapiens
MASSHWNETTTSVYQYLGFQVQKIYPFHDNWNTACFVILLLFIFTVVSLVVLAFLYEVLDCCCCVKNKTVKDLKSEPNPLRSMMDNIRKRETEVV

SEQ ID NO: 15077 - protein, 117 aa, Homo sapiens
METKKLIGKPLQPARPVRHLTSPPGAVFPFNFQNEYPCNTQCIQSGVSRCKTNGMQAFSQGLNEQQQQQSPVKKERIKYSRDFLLKLSSVSICRKKPDFLPDHPIVLQKPENNQSFK

SEQ ID NO: 15078 - protein, 112 aa, Homo sapiens
LQDRIATFFFPKGMMLTTAALMLFFLHLGIFIRDVHNFCITYHYDHMSFHYTVVLMFSQVISICWAAMGSLYAEMTENNAQRSHVLQPPVLGVSGHRVPGGAPLRPGESEQG

SEQ ID NO: 15079 - protein, 2235 aa, Homo sapiens
MPLFFSALLVLLLVALSALFLGRWLVVRLATKWCQRKLQAELKIGSFRFFWIQNVSLKFQQHQQTVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKAILRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 15080 - protein, 1291 aa, Homo sapiens
MPPNFPEFAERIEASLSEVSEAGASNPSLQEKKESSSALTESSGHLDHREPQSESVTLEHVSKSIGIPEVQDFKNLSGDCQDFRFQQHSANPPHEFQPVESEAVATSGNTDVMQESRFSSATWPRATKSLAKGGFSEKQHPLGDTACTVEMPPLSPCLSEELLDPELHVLITPSLREKTESELKFEEDERWIMMEAEGEWEEEKLSDREKTFLMADEKNSLADIFEEREQANTAVVEDGSDCLAAVLRTFGHLSLGQICCPDDPQPAKDQLATVPKDIPLDCDCVLTGEDILGEVANRTAQGLEGLVSDSACTVGTIDAEQLSDTDSVQMFLELEKECLCEEGVTPLVELQNQISSEGLAASQDAENLLVISHFSGAALEKEQHLGLLHVRAKDYDTRLDCGYFNTLDSSQVPNAVELIAHVDIMRDTSTVSKEECEKVPFSPRTAEFKSRQPADLDSLEKLDPGGLLNSDHRVSHEEKLSGFIASELAKDNGSLSQGDCSQTEGNGEECIERVTFSFAFNHELTDVTSGPEVEVLYESNLLTDEIHLESGNVTVNQENNSLTSMGNVVTCELSVEKVCDEDGEAKELDYQATLLEDQAPAHFHRNFPEQVFQDLQRKSPESEILSLHLLVEELRLNPDGVETVNDTKPELNVASSEGGEMERRDSDSFLNIFPEKQVTKAGNTEPVLEEWIPVLQRPSRTAAVPTVKDALDAALPSPEEGTSIAAVPAPEGTAVVAALVPFPHEDILVASIVSLEEEDVTAAAVSAPERATVPAVTVSVPEGTAAVAAVSSPEETAPAVAAAITQEGMSAVAGFSPEWAALAITVPITEEDGTPEGPVTPATTVHAPEEPDTAAVRVSTPEEPASPAAAVPTPEEPTSPAAAVPTPEEPTSPAAAVPPPEEPTSPAAAVPTPEEPTSPAAAVPTPEEPTSPAAAVPTPEEPTSPAAAVPTPEEPTSPAAAVPTPEEPTSPAAAVPTPEEPASPAAAVPTPEEPASPAAAVPTPEEPAFPAPAVPTPEESASAAVAVPTPEESASPAAAVPTPAESASFAAVVATLEEPTSPAASVPTPAAMVATLEEFTSPAASVPTSEEPASLAAAVSNPEEPTSPAAAVPTLEEPTSSAAAVLTPEELSSPAASVPTPEEPASPAAAVSNLEEPASPAAAVPTPEVAAIPAASVPTPEVPAIPAAAVPPMEEVSPIGVPFLGVSAHTDSVPISEEGTPVLEEASSTGMWIKEDLDSLVFGIKEVTSTVLHGKVPLAATAGLNSDEVIVHFDSGKGLKSKVRFAGLTWW

SEQ ID NO: 15081 - protein, 68 aa, Homo sapiens
MCLYCWDIEPSQVNPEGPRQHHPSEVTERQLANKRIQNMQHLKKEKRRLNKRFSRPSPIPEPGLLWSS

SEQ ID NO: 15082 - protein, 527 aa, Homo sapiens
MVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 15083 - protein, 153 aa, Homo sapiens
VRGASARPPLLGSEEPLSPASHPVREGGGGVSPPPGQPPCPGGRWGGQPSARPAAPSGREVGVSAPRPASRPVREVRGASARPPLLGSEEPLCPASRPVREGGGGVSPPPGQPPRPGGRGASARPPLLGSEEPLCAATTPSGRCAQQLIENGP

SEQ ID NO: 15084 - protein, 429 aa, Homo sapiens
MGLPSWTRRSRNHDVSGAPLPLECNHVGEALPPEMVTRLYDGMRRVDLTGKAKGPSENVSQEQFTASMSHLLKGNSEEKSLMIMKMISATEGPVKAREVQKFTEDLVGSVVHVLSHRQELRGWTGKEAPGPNPRVQVLAAQLLSDMKLQDGKRLLGPQWLDYDCDRAVIEDWVFRVPHVAIFLSVVICKGFLILCSSLDLTTLVPERQVDQGRGFESILDVLSVMYINAQLPREQRHRWCLLFSSELHGHSFSQLCGHITHRGPCVAVLEDHDKHVFGGFASCSWEVKPQFQGDNRCFLFSICPSMAVYTHTGYNDHYMYLNHGQQTIPNGLGMGGQHNYFGLWVDVDFGKGHSRAKPTCTTYNSPQLSAQENFQFDKMEVWAVGDPSEEQLAKGNKSILDADPEAQALLEISGHSRHSEGLREVPDDE

SEQ ID NO: 15085 - protein, 830 aa, Homo sapiens
MDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQAQKKCLNQTSPISAPKTTDGLRQAQIPGLLSTTLPGQDSGSKVISASLGTAQPQQEKVVGSSPGHPAVQVESHSGGQKRPAAKQLTKGAFILQQLQRDQAHTVTPDKSHFRSLSDAVQRLLSYHVCQGSMPTEEDLRKVDNEFETVATQLLKRTQAMLNKYRCLLLEDAMRINPSAEMVMIDRMFNQEERASLSRDKRLALVDPEGFQADFCCYLYS

SEQ ID NO: 15086 - protein, 455 aa, Homo sapiens
MVEQGDAAPLLRWAEGPAVSLPQAPQPQAGGWGRGGGGGARPAAEPPRRREPEEPAAPEVLLQPGRLELGDVEEDQVVAVFVVTFDPRSGNMVEWCLPQDIDLEGVEFKSMASGSHKIQSDFIYFRKGPFFGLACFANMPVESELERGARMKSVGILSPSYTLLYRYMHFLENQVRHQLEMPGHYSHLAAFYEDKKGVLHAGPGRGSSLPPVYWLPSIHRYMYPEMKITHPAGCMSQFIKFFGEQILILWKFALLRKRILIFSPPPVGVVCYRVYCCCCLANVSLPGIGGTIPESKPFFYVNVADIESLEVEVSYVACTTEKIFEEKRELYDVYVDNQNVKTHHDHLQPLLKINSADREKYRRLNEQRQMLLYSQEVEEDYNPCEEDLFVLFFLEQNNRIFQTLLEVSASQDKTLTAEHARGMGLDPQGDRSFLLDLLEAYGIDVMLVIDNPCCP

SEQ ID NO: 15087 - protein, 744 aa, Homo sapiens
MEDCLHTSSENLSKLVSWAHSHGTICSLIPNLKHLLSEGSHGNLTAMWGCSAGHAYHWPLTATCRAGSQERVCFQDNRSFNSDSPSIIGVPSETQTSPVERYPGRPVKAKLDCNRTRDSCDFSYCSEPSELDETVEEYEDENTLFDMVCESSVTDEDSDFEPQTQRPQSIARKRPGVVPSSLHSSSQTQMVDECSNDVIIKKIKQEIPEDYYIVANAELTGGVDGPALSLTQMAKPKPQTHAGPSCVGSAKLIPHVTSAISTELDPHGMSASPSVISRPIVQKTARVSLASPNRGPPGTHGTNQQVAMQMPVSTSHPNKQISIPLSALQLPGQDEQVASEEFLSHLPSQVSSCEVALSPSVNTEPEVSSSQQQPPVAPAITTEATAQCIPDQDERAAELSREQNEKTIRSTQTALRNFPYSTKLNKFPVFNINDDLNDLCTSAVSPNTTKATRYALNVWRYWCMTNGLKDHTDITKIPAVKLNELLENFYVTVKKSDGSDFLATSLHAIRRGLDRILKNAGVGFSITSSTFSSSTKKLKEKLWVLSKAGMSGARSRNIVYFSLSDEEEMWQAGCLGDDSPITLLSTVVKYNSQYLNMRTLQEHADLMYGDIELLKDPQNQPYFARTDSVKRESRSGSTRVCHGKIYHEHSRGHKQCPYCLLYKYMYIHRPPTQMEAKSPFYLTARKEATDMGSVWYEEQRMGLRSLRGIVPNLAKKVKLENCENFTFVSFTQVSRRLGSHSCCQ

SEQ ID NO: 15088 - protein, 36 aa, Homo sapiens
KEKKEERKKERKKEERKKERKKERKKEKERKKEKER

SEQ ID NO: 15089 - protein, 153 aa, Homo sapiens
VRGASARPPLLGSEEPLCPASRPVREGGGGVSPPPGQPPRPGGRWGGQPPARPAAPSGREVGGGQPPCPASRPVREVRGASARPPLLGSEEPLCPASRPVREGGGGVSPPPGQPPRPGRGASARPPLLGSEEPLCPATTPSGRCAQQLIENGP

SEQ ID NO: 15090 - protein, 88 aa, Homo sapiens
MPGVVSAAGTQVRRLDEVPASLRLQHHLQLREGLAVPLPPLVIQSPAAHHVAGGSFSDFTLDIALGARRIRLALVRQVTQDGPVAFLA

SEQ ID NO: 15091 - protein, 151 aa, Homo sapiens
MLRWFVQQPTSCSHAQPLPPPHGTASLSPLVPSCGSAAWPSLHYLGSPADSGCSRGQRALPAVWPPSCYSQCPQGRPPHPVPRSPRRGSRDLGKEPGEEAAPWPSPCDSRLHRHPMPRTPLSASAGCDPSLIQPSPHPTPPQQGCVTPFHR

SEQ ID NO: 15092 - protein, 918 aa, Homo sapiens
MNENMRATLATSKNVFQLKLEETQKLLEDQHLSNLQKFGDEVNQITNSETLSSIDSLEATEHEEIYLTLNKEHSTSIQRNTISLKPANMQSTNLSCFDEDKLAFSKTQHINNWLTNLDASNTQNVTAFSDILSKSNVLPSWEYFNSKEQNPSPLNGTVERATNTANNSVPFVSSPPMFVLDKKCEKTSETSTMRTTDSTSGAFKRERPLVTESPTFKFSKSQSTSDSLTQEVATFPDQEKYSELNQENGTTSIPTSCVPVATPLVLPSNIQSARPSAKNSIHIKEIDAVQCSDKLDELKDGKEEEIKYFNCNKEELPLFSDSFQDAYIPHNPDSKDEKQKLAETSSLSNVTSNYDFVGQHKKMKYNIHERNGVRFLKSILKKESKYEHGYLKALIINQSFKFGNQKAAAIRDSIELTKEKGAEIPKTIKKLRWFDETSNIENNAENSHSLKNKTGTTQQHSQQFHIQSGAGSNIISVSTCAVNSADTKKSREDSISENVTTLGGSGADHMPLNCFIPSGYNFAKHAWPASKKEESKIPVHDDSKTKQGKPQRGRAKIIRKPGSAKVQSGFICTNRKGAVIQPQSASKVNIFTQAQGKLIIPCPPPQSTSNIRSGKNIQVSQCQPVTPENPQNIITHNSFNSKHVLPTEHSLNQWNQESSSPLSNACSDLVTVIPSLPSYCSSECQTFAKINHSNGTQAVARQDATLYCTQRSPVCEESYPSVTLRTAEEESVPLWKRGPNVLHQNKRATGSTVMRRKRIAETKRRNILEQKRQNPGSVGQKYSEQINNFGQSVLLSSSEPKQTTRGTSYIEEVSDSTSEFLMAENLVKASVPEDEILTVLNSKQIQKSNLPLNKTQQFNICTLSAEEQKILESLNDLSERLHYIQESICKNPSIKNTLQIIPLLEKREDRTSSCRDKR

SEQ ID NO: 15093 - protein, 152 aa, Homo sapiens
LPLFCSSGILQKEFWRNRIQYNQSQKDILQSWFQHDPFPDKAAREQLAKEIGVPESNIQVWFKNYRVKQRKLDYKCFSEKDQTQGHDQSQHLTQEYLPKEARQKQTFITWTQKNRLVQAFERNPFPDIATRKKLAEQTGLQESRIQVSSMCV

SEQ ID NO: 15094 - protein, 1309 aa, Homo sapiens; identical to SEQ ID NO: 15023

SEQ ID NO: 15095 - protein, 1226 aa, Homo sapiens
MGEQKVSRQFKQCHRTTSWAKSKLFSRLSSMFLQQLGKNIKFGQRSPNAIPMNKANSGEASLEEDLFLTSPMEIVTQQDIVLSDAENKSSDTPSSLSPLNLPGAGSEMEEKVAPVKPSRPKRHFSSAGTIESVNLDAIPLAIARLDNSAAKHKLAVKPKKQRVSKKHRRLAQDPQHEQGGLESRPCLDQNGHPGEDKPTWHEEEPNPLDSEEERRRQEDYWRELEAKCKRQKAEAAEKRRLEEQRLQALERRLWEENRRQELLEEEGEGQEPPLEAERAPREEQQRSLEAPGWEDAERREREERERLEAEEERRRLQAQAQAEERRRLEEDARLEERRRQEEEEGRCAEELKRQEEEEAEGWEELEQQEAEVQGPPEALEETGEGRRGAEEEDLGEEEEEGQAHLEDWRGQLSELLNDFEERLEDQERLKPEGQREHSEEPGICEEQNPEAERRREQQGRSGDFQGADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPRQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 15096 - protein, 845 aa, Homo sapiens
MAQVWRRVSEHFWESETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 15097 - protein, 107 aa, Homo sapiens
MLSKGRSPRRKQVQTQRKAALVLSVTPMVPVGSVWLAMSSVLSAFMRELPGWFLFFGVFLPVTLLLLLLIAYFRIKLIEVNEELSQNCDRQHNPKDGSSLYQRMKWT

SEQ ID NO: 15098 - protein, 291 aa, Homo sapiens
IRPFSSVNSLVLNEASTLAKRLSTFTTFIRPFSSMKSPVLNEARALSKRFATFTALIRSCASMNSPVLNEVRFAGKGFSTFTAFIRSFSSVNSLVLNQDKFAAKGFLTFTALIRPITSVNAAVSNEVRELSKGFPTFSAFIRSFSTVNSLVLNEFRFAAKRFPTITALIRHFSSVNSSMSNEIEDLSKGFPTLTALIRPFSRVNSLVSKKARALSKGFPALATFIRPFSSVNSLVFNEVRFVAKGFPTFTTLMTHSSSVTSLVVNEFRFMDKGFLTITAFIRPFSSVNYLV

SEQ ID NO: 15099 - protein, 223 aa, Homo sapiens
KPYACNECVKSFCVKSSLIIHQRTHTGEKPYKCNEYGKTFHHKSTLTVHQRTHGEKPYKCNECRKSFYMKSALSQHQRIHIWEEHCECKECGKTYQRSHLAKHHRKYTKKPYECKQCGKTFQKSHLIEHQRTHPGEIPHECNKCGKSFCYKSPLTIHQRTHIEEKPYKCSKSVTYFCMKSHLTVHQRPHTRKNPFECNECRKMFYVKSNLINHQRTHTGEKPY

SEQ ID NO: 15100 - protein, 206 aa, Homo sapiens
MKAGFHLNPKAIEASLQGCCSEAEAQQTGRRQTPPQPMQCELPTVPVQIGSHFLKGVSFNESAADNLKLKTHTMLQLMKEAGCYNGITSRDDFPVTEVLNQVCPSTWRGACKTAVQLLFGQAGLVVVDTAQIENKEAYAPQISLEGSRIVVQVPSTWCLKEDPATMSLLQRSLDPEKTLGLVDVLYTAVLDLNRWRAGRLVYLSFF

SEQ ID NO: 15101 - protein, 1314 aa, Homo sapiens
MEKHNALRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 15102 - protein, 205 aa, Homo sapiens
MEDGGQREEETRRNATCGAAAKSENRGKRHASAGKKGAGGTSPTAPSTKRPLPGLSAPLGAGSASSPPLRAPVPRSECPGRRRPVLAARSDALESSPISLPATPVRRPLLSYSAPTHLGTPGGARGHLQGEGLRGQGKPPVWRVRRALPPGWTQQAEAQEQGSATRAGLGARRGVGTASWGWTWATCGRKGARNRKRSDERPRPP

SEQ ID NO: 15103 - protein, 450 aa, Homo sapiens
MNRVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHVNLQEVSSPSRRGGLHL

SEQ ID NO: 15104 - protein, 418 aa, Homo sapiens
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEGQTQLLLSPAWRNAVNFGSSQWGIPGKVILSNVWNRRQMPWGNSL

SEQ ID NO: 15105 - protein, 400 aa, Homo sapiens; identical to SEQ ID NO: 14802

SEQ ID NO: 15106 - protein, 69 aa, Homo sapiens
MMVLTPFWLGRDCPSRGQPTLREGKGLSVPFTCKLNNPQRYLLYLTHTPRRQYSPAWYLPGKLGITLTV

SEQ ID NO: 15107 - protein, 390 aa, Homo sapiens
CEKSTFFKHQKRTHTVEKTFECSHGKKSFCQESHFTEHHRTCTREKPCESNKYGKTFHQKRSFIHHQRTHTGEKPYECKECRKSFHVKPNLTKHQKTHIGEKPFKCTACGRTFFQQSTLNVHQGKHTEEKPYKYTECEKSFYKSVLIIHERTHTGEKPCGCNECEKSFEVLTTLVIHQRTHTGEKPYKCNECEKSYLNLKSHLNIHLRNHTGKRPHVCNECGKAFSMKSNFTDHQRTHCGEKPYKCNECRKSFYMKSALSQHQRIHIYKKPYECKQCGKTFQKSHLIEHQRTHPGEIPHECNKCGKSFCYKSPLTIHQRTHIEEKPYKCSKSVTYFCMKSHLTVHQRPHTRKNPFECNECRKMFYVKSNLINHQRTHTGEKPYEGNTCGK

SEQ ID NO: 15108 - protein, 2092 aa, Homo sapiens
MVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 15109 - protein, 856 aa, Homo sapiens
MSGELQRKIGLKVLEMRGNAVVGYLQCFDLEGESGLVVRAIGTACTLDKLSSPAAFLPACNSPSKEMKESPLVHPPSHGCRSTHNSPIHTATGSRLTQNFSVSVPTLIYTGMGSGSAGKEGGPFKALLRQQTQSALEQREFPFFTLTAFPPGFLVHVGGVVSARSVKLLDRIHNPAFVGIMGNTRSYKLLDWNSFNSDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKEHLESASSNSGIPAAQRDRCSSWIELIKLKAQTIRRGSIKTTMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 15110 - protein, 514 aa, Homo sapiens
MMEDLGRKENQDKKQQKDPRLTMEMRHKQVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRKQQLATEYNRKQVLRHCFTEWQHWHGAELLKRELALTKEETRKKMDALLQAASLGKLSANGLSGISLPEEATAMVGPPVKNGQETAVPPLWEKPPLGSSGCMLSPPLGRTTTGNLQGSLQNVSLSAPGNKQHKTLGAEPSQQPGSNETLRTTSQKAEPLCLGHFHNRHVFQQQLIEKQKKKLQEQQKTILELKKNLQLAEAQWAAEHALAVTEAQSHLLSKPREEEPRTCQMLVNSPVASPGTEGRSDSRNSLSGLRRKPKQLMTPHPILKGRAVSVVALVVVIFSPRVECVHWD

SEQ ID NO: 15111 - protein, 760 aa, Homo sapiens
MGDPGSEIIESVPPAGPEASESTTDENEDDIQFVSILFPKMPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNCLNTRYSATRIAEHIAKEMKMKIFKNIIEENAKICIIIDEASTVSKKTTLVIYLQCTIQSAPAPVMLFVALKELVSTIAECIVNTLLTTLNDCGFTNEYLKANLIAFCSDGANTILGRKSGVATKLLENFPEIIIWNCLNHRLQLSLDDSISEIKQINHLKIFIDKIYSIYHQPNKNQTKLLGTVAKELETEIIKIGRVMGPRWAACSLQAATAVWHAYPILYMHFSHSYSGLAKRLANINFLQDLALMIDILEEFSVLSTALQSRSTNIKKAQKLIKRTIRALENLKIGTGKYESQIEDLIKSDKFKDIPFNKNNKFNALPRSILLDNIIQHMNLRLLSDRNHEDIFNYFDLLEPSTWPYEEITSPWIAGEKTLFHLCKILKYEVDLNDFREFVNNNIKSNNVSIPTTIYKAKKIVSTIAINSAEAERGFNLMNIICTRVRNSLTIDHVSDLMTINLLGKELADWDATPFVKSWSNCNHRLATDTRVRQKSTKVFHENQLAIWNLK

SEQ ID NO: 15112 - protein, 409 aa, Homo sapiens
MTLSRGKVDFATIQCGQCLMETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKILRKLKGYDSYNTLLLPPRNPGEKLPPELYEYFKEIKKSKEEQMRAKYLENLAQENEEEDITSSDQGTSNSTKRTSLSRGISVTSNLEEWHALLVESKTYLEEEEDEESLEKIIFQTDKLQSIDSHSMEEVGEVENNPVSKAIARHLGIDISAEGRLAKNRKGIAIIIHGTPLSGKSANAVSVAKYYNAACLSIDSIVLEAVANSNNIPGIRACELCIRAAIEQSMKEGEEAAE

SEQ ID NO: 15113 - protein, 124 aa, Homo sapiens
MAVYTHTGYNDHYMYLNHGQQTIPNGLGMGGQHNYFGLWVDVDFGKGHSRAKPTCTTYNSPQLSAQENFQFDKMEVWAVGDPSEEQLAKGNKSILDADPEAQALLEISGHSRHSEGLREVPDDE

SEQ ID NO: 15114 - protein, 868 aa, Homo sapiens
MGITESSDTPSSLSPLNLPGAGSEMEEKVAPVKPSRPKRHFSSAGTIESVNLDAIPLAIARLDNSAAKHKLAVKPKKQRVSKKHRRLAQDPQHEQGGLESRPCLDQNGHPGEDKPTWHEEEPNPLDSEEERRRQEDYWRELEAKCKRQKAEAAEKRRLEEQRLQALERRLWEENRRQELLEEEGEGQEPPLEAERAPREEQQRSLEAPGWEDAERREREERERLEAEEERRRLQAQAQAEERRRLEEDARLEERRRQEEEEGRCAEELKRQEEEEAEGWEELEQQEAEVQGPPEALEETGEGRRGAEEEDLGEEEEEGQAHLEDWRGQLSELLNDFEERLEDQERLKPEGQREHSEEPGICEEQNPEAERRREQQGRSGDFQGADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPRQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPGPPVRPHQHPHFPN

SEQ ID NO: 15115 - protein, 102 aa, Homo sapiens
VLLCCPGWSAVVRSWLTATSASWQLAGITGMCHHAQLIFVFFIETEFHHVGQAGPELLTSGDPSASASQSAGITGASHPRRANFCIFGRDGVSPCWPGWSST

SEQ ID NO: 15116 - protein, 131 aa, Homo sapiens
SACMCVCVCVCMYIYIYIYIFFFFFFFFFLNIFKQAPPRQNQVRRPGAVAHTCNPSTVGGHGGQITRGQEFETSLANMGETPSLLKIQTWPGVVAHACNPSYSGGRLRQENCLNLGGGGCGEIALQPGQQE

SEQ ID NO: 15117 - protein, 102 aa, Homo sapiens
EVGRWLEPGKQRLQCAEMAPLHSSLGDKARPCLTKKKKMLDMNPTLVCYRQGLALLPRLGCSGAILAHCNLRLLGSSDSPASASRVAGITGARHHAQLIFVF

SEQ ID NO: 15118 - protein, 95 aa, Homo sapiens
FFFFLRWSLALLPRVECSGMISAHYNLHLPGSSDSPASASRVAGTTGVHHHAWLIFCIFSRDGVLLCCPGWSPTPGLKRSSCLGFRKCWDYRHEP

SEQ ID NO: 15119 - protein, 114 aa, Homo sapiens
WCTPLIPATEVETGRWVEPRSSRLGFFLVELLSFDLGNRARLHLKKKKKKKSLGKIYFFLRWSLALLPRLGCSGAISAHCKLHLLGSHHSPASASRVAGITGARHHTRLIFFFL

SEQ ID NO: 15120 - protein, 131 aa, Homo sapiens
SACMCVCVCVCIYIYIYIYIFFFFFFEFLTKLIKQLVMIKNQVRRPGAVAHTCNASTVGGHGGQITRGQEFETSLANMGETPSLLKIQTWPGVVAHACNPSYSGGRLRQENCLNLGGGGCGEIALQPGQQE

SEQ ID NO: 15121 - protein, 127 aa, Homo sapiens
ILAHCNLHLPNSSDSPASASQVAGITGTCYHTQLIFVFLVETGFHHVGQDGLELLTSGDLPASASQSAGITGVTHCAQPSSLLTSEGRKETVSTFFFFFLHETVSHSVAQARVQWHNLSSLQPPPSR

SEQ ID NO: 15122 - protein, 95 aa, Homo sapiens; identical to SEQ ID NO: 15118

SEQ ID NO: 15123 - protein, 31 aa, Homo sapiens
AKPRLHQPGQSGETPSLLKIQKLARRGGVHL

SEQ ID NO: 15124 - protein, 87 aa, Homo sapiens
SVAQAGVQWHNLGSLQPPPPRFNRFSCLSIPSSWDYRHSPPLLADFCIYLVETGFHHVGQAGLELLTSSDLPTSASQSARITGVSHR

SEQ ID NO: 15125 - protein, 64 aa, Homo sapiens
PRRWSLQVYPTAPKRQRPSRMGHDDNGSFVEKKRGKCGEKKERSDCYYVCVERSRHRRLHFVLY

SEQ ID NO: 15126 - protein, 151 aa, Homo sapiens
RFYIGCDLCTNCYYGECVGIAEKEAKKMDVYICNDCKWAQEGSSEELYCICRTPAGSCRFFIGHDRCQNWYHGCCIGILQSEAELIDEYVCPQCQSTEDAMAVLTPLTEKDDEELKRVLCSLQTHKMAQPFLEPVDPNDAPDYYGVIKEPM

SEQ ID NO: 15127 - protein, 136 aa, Homo sapiens
GTISAHCNLCLLDSSDSPASASRVAGIIGAHHHAQLIFVFLVEMGFHHVGQAGLKLLTSDPPASASQSAGITGVSHHNWLHGGPDRVKRPPVFFFWFFFFEMESYSVAQAGVQWRDLSSLQPPPPRHTILLPQPPE

SEQ ID NO: 15128 - protein, 92 aa, Homo sapiens
LTPDGFFFRVHMLVLDSSSCNKPCPEFKPGSRYIVMGHIYHKRGQLPTALLQVLRGHLCPGDGLLRSSSSYVKRFNPKREGQIQGAIHTQCI

SEQ ID NO: 15129 - protein, 125 aa, Homo sapiens [sequence omitted]

SEQ ID NO: 15130 - protein, 132 aa, Homo sapiens
CMCVCVCVCIYIYIYIYISQPIYIFLLLLLLLFLRQSLMIKNQVRRPGAVAHTCNPSTVGGHGGQITRGQEFETSLANMGETPSLLKIQTWPGVVAHACNPSYSGGRLRQENCLNLGGGGCGEIALQPGQQE

SEQ ID NO: 15131 - protein, 36 aa, Homo sapiens
GRDDWQAAPPAAPVRDPLGEASWAPECGGDLENLYV

SEQ ID NO: 15132 - protein, 106 aa, Homo sapiens
FFLSFLHSFFLRQSFALVAQAGVQWHNLGSLQPPPPGFKQFSCLSLLSSWDYRHVPPCPANFVFLVEMGFLHVGQAGLELRTSGDPPTLASQSAGITGVSHRAQPS

SEQ ID NO: 15133 - protein, 91 aa, Homo sapiens
FFLRWSLTLSSRLECSGATSAHCNVRLPGSRHSPTSASRVAGTTGARHLSRLIFIFSRDGVSPWSRSPDLAIRPPRPPKKLGLQAPATMPG

SEQ ID NO: 15134 - protein, 126 aa, Homo sapiens [sequence omitted]

SEQ ID NO: 15135 - protein, 108 aa, Homo sapiens
QIKSKFFFFLRRSLALSPRLECSGGISAHCKLRLPGSRHSPASASQVAGTTGARHYARLIFLFLIETGFHYVGQAGLELLTSGDLPTSASQSAGITGVSHCTQPEDIF

SEQ ID NO: 15136 - protein, 122 aa, Homo sapiens
WDYSFFFFLRQSHSVPQAGVQWCNLSSLQPPPSRFKRFSCLSLLSSWDYRHTPPCPANFCIFRTFFFFLRWSFALSPRLECSGAILVHCNLCLPGSSDSCLSLPISWDYRCAPPCLANFCIF

SEQ ID NO: 15137 - protein, 123 aa, Homo sapiens
WDYSFFFFLRQSHSVPQAGVQWCNLSSLQPPPSRFKRFSCLSLLSSWDYRHTPPCPANFLYTFELFFFFLRWSFALSPRLECSGAILVHCNLCLPGSSDSCLSLPISWDYRCAPPCLANFCIF

SEQ ID NO: 15138 - protein, 123 aa, Homo sapiens; identical to SEQ ID NO: 15137

SEQ ID NO: 15139 - protein, 26 aa, Homo sapiens
FLMDKSSLTGALCSITLASPCGTPGI

SEQ ID NO: 15140 - protein, 105 aa, Homo sapiens
ETGRWVEPRSSRLGFFLVELLSFDLGNRARLHLKKKKKKKIPGKHCVCFMRWSLALLPRLGCSGAISAHCKLHLLGSHHSPASASRVAGITGARHHTRLIFFFFV

SEQ ID NO: 15141 - protein, 75 aa, Homo sapiens
CFSHSFFFFFFFLRWSLALSPRLECSGAISAHCKLRLLGSRHSPASASRVAGTTGACHHARLFFCIFSRDGVSPC

SEQ ID NO: 15142 - protein, 107 aa, Homo sapiens
VLNGAQAGVQWRDLGSLQPPPPSHLPRPSKVPRVQPLPGRHPVWEVRGVSAWPPIVWDVRSPSAWLPSLESEERLCPAAIPSRKWGAPVPRRPIWDVRSVSAQPPRL

SEQ ID NO: 15143 - protein, 95 aa, Homo sapiens; identical to SEQ ID NO: 15118

SEQ ID NO: 15144 - protein, 132 aa, Homo sapiens
CMCVCVCVCMYIYIYIYISQPIYIFLLLLLLLFLRQSLMIKNQVRRPGAVAHTCNPSTVGGHGGQITRGQEFETSLANMGETPSLLKIQTWPGVVAHACNPSYSGGRLRQENCLNLGGGGCGEIALQPGQQE

SEQ ID NO: 15145 - protein, 93 aa, Homo sapiens
SVAQAGVQWHNLGSLQPPPPRFNRFSCLSIPSSWDYRHSPPRLADFLFLVETEFCHVGQAALELLTSGDLPTSASQSARITGVSHRTRPSLFY

SEQ ID NO: 15146 - protein, 140 aa, Homo sapiens
GTISAHCNLCLLDSSDSPASASRVAGIIGAHHHAQLIFVFLVEMGFHHVGQAGLKLLTSDPPVSASQSAGITGVSHHREPQHPFLLSVESRDRPFFFFGFFFFEMESYSVAQAGVQWRDLSSLQPPPPRAQAILPPQPPK

SEQ ID NO: 15147 - protein, 131 aa, Homo sapiens [sequence omitted]

SEQ ID NO: 15148 - protein, 50 aa, Homo sapiens
PSFLLFFLPSFLPFSLSSLSFLPFLLSFLTGSHLFSITHTHTHTHTHTHT

SEQ ID NO: 15149 - protein, 140 aa, Homo sapiens; identical to SEQ ID NO: 15146

SEQ ID NO: 15150 - protein, 131 aa, Homo sapiens [sequence omitted]

SEQ ID NO: 15151 - protein, 92 aa, Homo sapiens
FFFFFFETDCRSVTRLECSGIISAHCKLCLPGSSDSPASASQAARTIGTCHHTQLIFVFFVETGFHHVGQDGLNLSLVIHPPRPPKVLGLQV

SEQ ID NO: 15152 - protein, 75 aa, Homo sapiens; identical to SEQ ID NO: 15141

SEQ ID NO: 15153 - protein, 58 aa, Homo sapiens
PGGAAAAASVMAPRRSRCFCTSICGGRGARPQLPRTCGDGTQHCGRGKPALAAAEEWP

SEQ ID NO: 15154 - protein, 123 aa, Homo sapiens
VCVCVCVCVCVCLFIYFSVFWSFLYLFVFLLKIYEKRPCAVAHACNPPGVVAHACNPSTLGGRGGQISWSQEFETSLANMSKTPSRKKRKGWSGVVAHACNHSYSGLRQENCLNPVGGGCVQP

SEQ ID NO: 15155 - protein, 95 aa, Homo sapiens; identical to SEQ ID NO: 15118

SEQ ID NO: 15156 - protein, 86 aa, Homo sapiens
GTISAHCNLCLLGSSDSPASASQVAAGITGACHLAQLIFIFLIETGFHHAVQAGLKLLTLSDLPASASQSVGITGASHRADPKVFL

SEQ ID NO: 15157 - protein, 21 aa, Homo sapiens
NRKKEGKKNQSPPPTVSPLAT

SEQ ID NO: 15158 - protein, 100 aa, Homo sapiens
FLRRSLALSPRQWHDLGSLQPPPPGFKPFSCLSLLSSWDYRCAPPCPANFCILVEMGFHHVGQAGLELLTSDLPTSASQRAGITGVNHHAWPRDAFSISY

SEQ ID NO: 15159 - protein, 93 aa, Homo sapiens
SVAQAGVQWHNLGSLQPPPPRFNRFSCLSIPSSWDYRHSPPLLADFLFLVETEFCHVGQAALELLTSGDLPTSASQSARITGVSHRTRPSLFY

SEQ ID NO: 15160 - protein, 36 aa, Homo sapiens
KRKKKERKKERKKKERKKERKKERKKEKERKKEKER

SEQ ID NO: 15161 - protein, 77 aa, Homo sapiens
INCYSFYSLFLFVCITDGVSLSPRPECSGAISAHCRLRPRGSRHSPASASRVAGTTGARHLAQLIFCIFSRDGVSLC

SEQ ID NO: 15162 - protein, 73 aa, Homo sapiens
RRERPLPEPHSQFFFFFFFYYTLSFRVHVHIVQVSYICIHVPCWCAAPTNVSSSIRYISQCYPSPLPRPHHSP

SEQ ID NO: 15163 - protein, 40 aa, Homo sapiens
SPPPPGGGEKPLAPPPGWVEPPKWLGLQGPSGGPGAGPGL

SEQ ID NO: 15164 - protein, 105 aa, Homo sapiens
YFYFLRQSLTLSPRLECSGTISAHCNLCLPGSSNSPASASQVAGITGVCHHTQLIFVFLVEMGFCHVGQAGLELLTSGNPPALAFQSAGITGMSHHAWPGHMFFK

SEQ ID NO: 15165 - protein, 71 aa, Homo sapiens; identical to SEQ ID NO: 12788

SEQ ID NO: 15166 - protein, 55 aa, Homo sapiens
VIGWVWWLTPVIPALWEAEAGGSPEIRSSRPAWPTWGNPSLLKIQKLARRGGAHL

SEQ ID NO: 15167 - protein, 121 aa, Homo sapiens [sequence omitted]

SEQ ID NO: 15168 - protein, 139 aa, Homo sapiens [sequence omitted]

SEQ ID NO: 15169 - protein, 75 aa, Homo sapiens; identical to SEQ ID NO: 15141

SEQ ID NO: 15170 - protein, 100 aa, Homo sapiens
FLRRSLALSPRQWHDLGSLQPPAPGFKPFSCLSLLSSWDYRCAPPCPANFCILVEMGFHHVGQAGLELLTSDLPASASQRAGITGVNHHAWPRDAFSISY

SEQ ID NO: 15171 - protein, 416 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 15172 - protein, 123 aa, Homo sapiens; identical to SEQ ID NO: 15137

SEQ ID NO: 15173 - protein, 102 aa, Homo sapiens
VLLCCPGWSAVVRSWLTATSASWQLAGITGVCHHAQLIFVFFIETEFHHVGQAGPELLTSGDPSASASQSAGITGASHPRRANFCIFGRDGVSPCWPGWSST

SEQ ID NO: 15174 - protein, 126 aa, Homo sapiens
RHQAQLIFLYDLFLYVYFLKDRVLLCHPGWSAMTRSRLTATSASQVAGTIGMCHHARLIFFFFFVFLVEMGFHCVSQHGLELLTLDPPASASQSARIIGLNHCTQPTFCIFSRDGDSPCWPDWSRT

SEQ ID NO: 15175 - protein, 50 aa, Homo sapiens
PSFLLFFLPSFLPFSLSSLSFLPFLLSFLTGSFGQDKVFSITHTHTHTHT

SEQ ID NO: 15176 - protein, 123 aa, Homo sapiens
CVCVCVCVCVCLFIYFSVFWSFLYLFVFLLKIYEKRPCAVAHACNPPGVVAHACNPSTLGGRGGQISWSQEFETSLANMSKTPSRKKRKGWSGVVAHACNHSYSGLRQENCLNPVGGGCVQPR

SEQ ID NO: 15177 - protein, 92 aa, Homo sapiens; identical to SEQ ID NO: 15151

SEQ ID NO: 15178 - protein, 127 aa, Homo sapiens [sequence omitted]

SEQ ID NO: 15179 - protein, 103 aa, Homo sapiens
FFFFLRRSLALSPRLECSGGISAHCKLRLLGSRHSPASASQVAGTTGARHYARLIFLFLIETGFHYVGQAGLELLTSGDLPTSASQSAGITGVSHCTQPEDIF

SEQ ID NO: 15180 - protein, 80 aa, Homo sapiens
AHHLRSGAGDQPGQHGETPSLLKIEKLAEHGGSCFSFQVLGRLRQENCLNPGGGGCSEPRLCHCTPAWATEQGSVSRKKE

SEQ ID NO: 15181 - protein, 139 aa, Homo sapiens [sequence omitted]

SEQ ID NO: 15182 - protein, 105 aa, Homo sapiens
YFYFLRQSLTLSPRLECSGMISAHCNLCLPGSSNSPASASQVAGITGVCHHTQLIFVFLVEMGFCHVGQASLELLTSGNPPALAFQSAGITGMSHHAWPGHMFFK

SEQ ID NO: 15183 - protein, 153 aa, Homo sapiens
VRGASARPPLLGSEEPLSPASRPVREGGGGVSPPPGQPPCPGGRWGGQPSARPAAPSGREVGVSAPRPASRPVREVRGASARPPLLGSEEPLCPASRPVREGGGGVSPPPGQPPRPGGRGASARPPLLGSEEPLCAATTPSGRCAQQLIENGP

SEQ ID NO: 15184 - protein, 115 aa, Homo sapiens
MNVCCSSHPVNEKVWKPSSRKWSSKVWSMDEFDLQTACYWFMTRCQKEAGKFGTHRGKPMCFVRSLLRVQLLPRTFPANSFVISFFPSLIYPLQVYQLHFESSDKQRAMQFVTEG

SEQ ID NO: 15185 - protein, 105 aa, Homo sapiens; identical to SEQ ID NO: 15164

SEQ ID NO: 15186 - protein, 36 aa, Homo sapiens; identical to SEQ ID NO: 15160

SEQ ID NO: 15187 - protein, 139 aa, Homo sapiens [sequence omitted]

SEQ ID NO: 15188 - protein, 36 aa, Homo sapiens; identical to SEQ ID NO: 15160

SEQ ID NO: 15189 - protein, 35 aa, Homo sapiens
SPNKLLFDPRVGGRVSHVFFLFPPFVLLPGPPGLP

SEQ ID NO: 15190 - protein, 100 aa, Homo sapiens; identical to SEQ ID NO: 15170

SEQ ID NO: 15191 - protein, 132 aa, Homo sapiens; identical to SEQ ID NO: 15130

SEQ ID NO: 15192 - protein, 36 aa, Homo sapiens; identical to SEQ ID NO: 15131

SEQ ID NO: 15193 - protein, 75 aa, Homo sapiens; identical to SEQ ID NO: 15141

SEQ ID NO: 15194 - protein, 111 aa, Homo sapiens [sequence omitted]

SEQ ID NO: 15195 - protein, 153 aa, Homo sapiens; identical to SEQ ID NO: 15183

SEQ ID NO: 15196 - protein, 90 aa, Homo sapiens
QWSDLGSLQPPPPGFKRFSCLNLPTSWDYRHVPPRPANFCFFIEMGFLHVGQTGLELPTSGDPPASASQSAGITGVSHHAWPHFIILLMI

SEQ ID NO: 15197 - protein, 128 aa, Homo sapiens [sequence omitted]

SEQ ID NO: 15198 - protein, 118 aa, Homo sapiens
WCAPVAPATREVEVGGSLEPNRSRLQSAKIAPLHYSLGNRTRLCLKKKKKKSLFNKVCLFLRRSLTLSPRLEHSGMISAHCNLRLPGSSYSPVSASQVAGITGACHHTQLIFVFLVET

SEQ ID NO: 15199 - protein, 105 aa, Homo sapiens; identical to SEQ ID NO: 15164

SEQ ID NO: 15200 - protein, 117 aa, Homo sapiens [sequence omitted]

SEQ ID NO: 15201 - protein, 36 aa, Homo sapiens
KEKKEERKKERKKKERKKERKKERKREKERKKEKER

SEQ ID NO: 15202 - protein, 101 aa, Homo sapiens [sequence omitted]

SEQ ID NO: 15203 - protein, 140 aa, Homo sapiens; identical to SEQ ID NO: 15146

SEQ ID NO: 15204 - protein, 128 aa, Homo sapiens
WRAPVIPATREAEAGEWCEPRSTRIQEKDIAFLAFSLGDRVRLYLQKKKKKSKNNKTSLFLRLSLALSPRLECSGAISAHCNLHHLGSSDSPASASRVAGITGARHHTRFIFVFLVETSCWNLLVSNS

SEQ ID NO: 15205 - protein, 101 aa, Homo sapiens [sequence omitted]

SEQ ID NO: 15206 - protein, 36 aa, Homo sapiens
KRKKKERKKERRKKERKKERKKERKKEKERKKEKER

SEQ ID NO: 15207 - protein, 92 aa, Homo sapiens; identical to SEQ ID NO: 15151

SEQ ID NO: 15208 - protein, 36 aa, Homo sapiens; identical to SEQ ID NO: 15160

SEQ ID NO: 15209 - protein, 110 aa, Homo sapiens
CTRYFYFYLFCFIFIYLFFFLRWSLALSPRLECSGAISAHCKLHLPGSCHYPASASRVAGTTGARHHAWLIFCMFSKDRVSRWSQSPDIAICLPWPPKVLGLQAPATTPG

SEQ ID NO: 15210 - protein, 118 aa, Homo sapiens [sequence omitted]

SEQ ID NO: 15211 - protein, 58 aa, Homo sapiens; identical to SEQ ID NO: 14952

SEQ ID NO: 15212 - protein, 42 aa, Homo sapiens
KEENEEEKVKEKEKNKKRKKRKKSQSRRVYHQEKTHILWVST

SEQ ID NO: 15213 - protein, 102 aa, Homo sapiens; identical to SEQ ID NO: 15173

SEQ ID NO: 15214 - protein, 110 aa, Homo sapiens
FFFFFGNGVWLCHPGWSAVVQSRLTATSASWQLAGITGVCHHAQLIFVFFIETEFHHVGQAGPELLTSGDPSASASQSAGITGASHPRRANFCIFGRDGVSPCWPGWSST

SEQ ID NO: 15215 - protein, 24 aa, Homo sapiens
RETERTITDDGWMDGWMDGWMDGW

SEQ ID NO: 15216 - protein, 123 aa, Homo sapiens
FIFLRWSLSLSPRLECSGTISAHCNLCLPGSSHSSASASQVARITDVGYAPGQHGETPSLLKIQKLAGYGVANVYSQLLGRLRQENGVNPGGGTCSEPRSRHCTPAWATARLRLKKKKKKKKK

SEQ ID NO: 15217 - protein, 152 aa, Homo sapiens
SRFYIGCDLCTNCYYGECVGIAEKEAKKMDVYICNDCKWAQEGSSEELYCICRTPAGSCRFFIGHDRCQNWYHGCCIGILQSEAELIDEYVCPQCQSTEDVMTVLTPLTEKDDEELKRVLRSLQAHKMARPFLEPVDPNDAPDYYGVIKEPV

SEQ ID NO: 15218 - protein, 40 aa, Homo sapiens; identical to SEQ ID NO: 15163

SEQ ID NO: 15219 - protein, 31 aa, Homo sapiens; identical to SEQ ID NO: 15123

SEQ ID NO: 15220 - protein, 138 aa, Homo sapiens
GTISAHCNLCLLDSSDSPASASRVAGIIGAHHHAQLIFVFLVEMGFHHVGQAGLKLLTSDPPASASQSAGITGVSHHNWLFFSIFLKNSQETARFFFWFFFFEMESYSVAQAGVQWRDLSSLQPPPPRHTILLPQPPE

SEQ ID NO: 15221 - protein, 35 aa, Homo sapiens; identical to SEQ ID NO: 15189

SEQ ID NO: 15222 - protein, 122 aa, Homo sapiens
FIFLRWSLSLSPRLECSGTISAHCNLCLPGSSHSSASASQVARITDVGYAPGQHGETPSLLKIQKLAGYGVANVYSQLLGRLRQENGVNPGGGTCSEPRSRHCTPAWATARLRLKKKKKKKK

SEQ ID NO: 15223 - protein, 153 aa, Homo sapiens; identical to SEQ ID NO: 15183

SEQ ID NO: 15224 - protein, 70 aa, Homo sapiens
ISAHCNLCLLGSSNSLASASQVAGITGAHHQAQLIFVFLVETEFHHVGQAGLKLLTNEWLPVCLPKCWDY

SEQ ID NO: 15225 - protein, 121 aa, Homo sapiens
CVCVCVCVCVCVFIYFSVFWSFLYLFVFLIWAKEQDSVSKKKKKKPGVVAHACNPSTLGGRGGQITKQEFETSLSNMAKPPKVLGLQNWPGMVASTCNPSYGRLKQENHLIRGGRGCSEPR

SEQ ID NO: 15226 - protein, 91 aa, Homo sapiens
TFFFFFFETDCRSVTRLECSGIISAHCKLCLPGSSDSPASASQAARTIGACHHAQLIFVFFETGFHHVGQDGLLDLVIHPPRPPKVLGLQV

SEQ ID NO: 15227 - protein, 123 aa, Homo sapiens; identical to SEQ ID NO: 15137

SEQ ID NO: 15228 - protein, 254 aa, Homo sapiens
KVSHVYFFLHRHGNHPISQSFPHLSRLSIPQSRHCHPGPFSMSCWAHLPDGAVAGQRGSSLPSRGGRAEAPLTSRTGRLAGQGAPPTSLPDWVAAGRRRSSLPRWGGCRAERLLTSQTGQLPGGGAPHFSDGVVARQRVSSLLRRGGRAETLLTSQTGSRPGRGAPHIPDGAAGQRRSPHLRRWAAGQRRSSLPRWDGGRAETLLTFQTGQPGRGAPHIPDDGRPGRDTPHFPDGVAAGQRLQSRHFGRPRQAA

SEQ ID NO: 15229 - protein, 151 aa, Homo sapiens
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSR

SEQ ID NO: 15230 - protein, 135 aa, Homo sapiens
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVP

SEQ ID NO: 15231 - protein, 141 aa, Homo sapiens
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPC

SEQ ID NO: 15232 - protein, 157 aa, Homo sapiens
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSRNYLPIL

SEQ ID NO: 15233 - protein, 583 aa, Homo sapiens
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 15234 - protein, 102 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPT

SEQ ID NO: 15235 - protein, 115 aa, Homo sapiens
KMSPSQLIGFLLLWVPASRGEIVLTQSPDFQSVTPKEKVTITCRASQSIGSSLHWYQQKPDQSPKLLIKYASQSISGVPSRFSGSGSGTDFTLTINSLEAEDAAAYYCHQSSSLP

SEQ ID NO: 15236 - protein, 131 aa, Homo sapiens
MGPAVLGQGQEGQPEARACSGLLQPPKRPIVFKEKLTMKTDSLMEEKLECSLWCCLSDPSIPGRCCVLERRIVPWMQQESYSSSSPIWSVDSDEPNLTSVLERLEDTKENSSVRKETKLFSLFLMNIIFRN

SEQ ID NO: 15237 - protein, 136 aa, Homo sapiens
MGDSRRDVLHEPAIALLSSPQTQSRLQIDAFIARRCWGSQWDITGYIHQQDFPTAVFIGFSNEFNICIPHPFTEWLQCVRKYSQSWGVRKGQRHIRYGMCSERTHHLSRTYSSLLEREEKLAFYGVLTMCQIWCET

SEQ ID NO: 15238 - protein, 104 aa, Homo sapiens
EDIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPST

SEQ ID NO: 15239 - protein, 114 aa, Homo sapiens
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASS

SEQ ID NO: 15240 - protein, 123 aa, Homo sapiens
MCGQCQSSSGHMEEEAHPELCPHWPLQFSPQSHCRQAYGRDTHAGGPGARVDSGHHLGLFPGLLSTCPDGLCVFPVPSPTFSTSLHVLMECKVHQPGPLPGRGSADAGLRGLPQGRTLCVLTA

SEQ ID NO: 15241 - protein, 175 aa, Homo sapiens
MHGEKSHGRGQAGRQVPLKQQSVSGESQQGARQGAGQSTCYLSSAFLCNGSFPAGSMSLWDPQPKQAFPSVLWCSWAGVPGRRTGQRDPRVQERRGDFVSKLGAAVGGEPLALFGPHSWPGMGHRVPGLGAGFLLFAGFALEPWDSYHVVFEGWTIDMRRNEPERTRSLSAPGPL

SEQ ID NO: 15242 - protein, 556 aa, Homo sapiens
MHPMALHMVLPAHLPFLSPEVLRLLEVHVKKWMHFQRWGLPRRVEESLRQLMPNPPLYYQPGNDQPVSFNLNNTSQVSLHRSETISLQTWCSCVAGQPIQTFWVSEWSTMNPEQRHHCQQTPNPMALALPSPALKALSGPHPQSGGQDNDSGSDLQQKYSQLFCGLPSLHSESLVATFMGSQGLPKIENVPKPPLKDPFLFNDLSFPQLLPKTSPQSAPPSSPLSPNWVSPSDHQRAQINVPFLTLAEYEALEWHLLQRQLQLQWGWPAALQRSQHTQCLMQHEPCGKAQSPETTTASQTGKSISVLTRELLFFPEHARKLLEFHIQKQSIRHRWGLPQKIQQSIQLLLTSTDQQTVSSSSTALANVSIPQPVALEANGACDVLSPIAAPVSIPRPHLLTQVKAILQSHIDSKCGQIHQGKIPACVHRSWDCRISGVLAVAPFPCIPESQFLVLQTASDPDLHHKVMPWMPTALDQQQQALPGTVTEHPKLLRVLSVEAIEKLETTLRHKHLAFLSGLPALYYVALPRALAPAVTSQSVITEMEPSPVEIPAEPLI

SEQ ID NO: 15243 - protein, 207 aa, Homo sapiens
MGMRLQLLRDRRISSRGPGLHRAKADPQQQKRLTTGLMTQAETQKEAQQRQAAMRKTALWHTGHLQPKTHTHTGMHTQTHRERERNTQRLRDRERRENGRHTHRHTHTLTHTHTHRDTHTASYRRGIETHTTRQPLRLRGSAHDENDPRVREQPRGTQADLSSRSRMAARLLGRLTPTNTVRAGLRLGSRAASPDPAWGFLIVVGPL

SEQ ID NO: 15244 - protein, 126 aa, Homo sapiens
MGMRLQLLRDRRISSRGPGLHRAKADPQQQKRLTTGLMTQAETQKEAQQRQAAMRKTALWHTGHLQPKTHTHTGMHTQTHRERERNTQRLRDRERRENGRHTHTHTETHTQRHTEEALKHTPPGNP

SEQ ID NO: 15245 - protein, 230 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 15246 - protein, 279 aa, Homo sapiens
MGKGNEDSDLHCSSIQCSTDQPPFQQISFTEKGSDEKKPFKEKGKTAFSHSSEKHIQRQAGSEPNPNKENSEETKLKAGNSTAGSEPESSSYRENCRKRKMSSKDSCQDTAGNCPEKECSLSLNKKSRSSTAVHNSEIQETCDAHHRGHSRACTGHSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 15247 - protein, 282 aa, Homo sapiens; identical to SEQ ID NO: 12676

SEQ ID NO: 15248 - protein, 300 aa, Homo sapiens
MAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 15249 - protein, 377 aa, Homo sapiens
MAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMSYDNGLAQGAGLESHGGSTFCGIASLCLMGKLEEVFSEKELNRIKRWCIMRQQNGYHGRPNKPVDTCYSFWVGATLKLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 15250 - protein, 336 aa, Homo sapiens
MWVRTTLTIERWTKEKTEPKARSWDESRCRGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKKKKEKEKDKEEMDEKAKLKKKAKKGQLTKKKSPVKLEPSPPDVSRSLSARQLARMSESSPESREELESEDSYNGRGQGELSSEDIVESSSPRKRENTVQAKKTGAKPSQARKVNKRKSPPGSNPNLS

SEQ ID NO: 15251 - protein, 364 aa, Homo sapiens
MWVRTTLTIERWTKEKTEPKARSWDEALSDVNRLPSWERGHLLAGVASSTDVSTFSEAGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKKKKEKEKDKEEMDEKAKLKKKAKKGQLTKKKSPVKLEPSPPDVSRSLSARQLARMSESSPESREELESEDSYNGRGQGELSSEDIVESSSPRKRENTVQAKKTGAKPSQARKVNKRKSPPGSNPNLS

SEQ ID NO: 15252 - protein, 153 aa, Homo sapiens
MSITYVNRLPSWERGHLLAGVASSTDVSTFSEGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEE

SEQ ID NO: 15253 - protein, 338 aa, Homo sapiens
MSITYVNRLPSWERGHLLAGVASSTDVSTFSEGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKKKKEKEKDKEEMDEKAKLKKKAKKGQLTKKKSPVKLEPSPPDVSRSLSARQLARMSESSPESREELESEDSYNGRGQGELSSEDIVESSSPRKRENTVQAKKTGAKPSQARKVNKRKSPPGSNPNLS

SEQ ID NO: 15254 - protein, 100 aa, Homo sapiens
MGISEEGNLLSTVSPTVKALFGKTRVSPIFPFSPRSPFQPLIPRTPGSPWGPVGPASPLGPGFPIGPMGPGKPVGPKGPMLPLGPSGPVGPTSPLFPFCP

SEQ ID NO: 15255 - protein, 104 aa, Homo sapiens
MMSTEQMQPLELSEDRLDKLDPRCSHLGVFSEHLIKRYDVQERHPKGKMIPVLHNTDLEQKKPRRKDTPALHMSPFAAGVTLLRDERPKAIVEDDEKDGDKIAI

SEQ ID NO: 15256 - protein, 799 aa, Homo sapiens
MARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 15257 - protein, 155 aa, Homo sapiens
MMSTEQMQPLELSEDRLDKLDPRCSHLDDLSDQFIKDCDLKKKPRKGKNVQATLNVESDQKKPRRKDTPALHIPPFIPGVFSEHLIKRYDVQERHPKGKMIPVLHNTDLEQKKPRRKDTPALHMSPFAAGVTLLRDERPKAIVEDDEKDGDKIAI

SEQ ID NO: 15258 - protein, 613 aa, Homo sapiens [sequence omitted]

SEQ ID NO: 15259 - protein, 613 aa, Homo sapiens [sequence omitted]

SEQ ID NO: 15260 - protein, 613 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSRKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 15261 - protein, 76 aa, Homo sapiens
LKISFSETALETTYQYPSESSVLEELGPEPEVPSAPNPPAAQPDDEEDEEELLLLQPELQGGLRTKALIVDESCRR

SEQ ID NO: 15262 - protein, 613 aa, Homo sapiens; identical to SEQ ID NO: 15260

SEQ ID NO: 15263 - protein, 76 aa, Homo sapiens; identical to SEQ ID NO: 15261

SEQ ID NO: 15264 - protein, 377 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLIMSLAGKGNQHLVTCFPHPVSGGRANCPISTLIQSPWCGWG

SEQ ID NO: 15265 - protein, 377 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESGLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLIMSLAGKGNQHLVTCFPHPVSGGRANCPISTLIQSPWCGWG

SEQ ID NO: 15266 - protein, 769 aa, Homo sapiens
MASAELQGKYQKLAQEYSKLRAQNQVLKKGVVDEQANSAALKEQLKMKDQSLRKLQQEMDSLTFRNLQLAKRVELLQDELALSEPRGKKNKKSGESSSQLSQEQKSVFDEDLQKKIEENERLHIQFFEADEQHKHVEAELRSRLATLETEAAQHQAVVDGLTRKYMETIEKLQNDKAKLEVKSQTLEKEAKECRLRTEECQLQLKTLHEDLSGRLEESLSIINEKVPFNDTKYSQYNALNVPLHNRRHQLKMRDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKPLLESVPYEEALANRRILLSSTESREGLAQQVQQSLEKISKLEQEKEHWMLEAQLAKIKLEKENQRIADKLKNTGSAQLVGLAQENAAVSNTAGQDEATAKAVLEPIQSTSLVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 15267 - protein, 780 aa, Homo sapiens
MASAELQGKYQKLAQEYSKLRAQNQVLKKGVVDEQANSAALKEQLKMKDQSLRKLQQEMDSLTFRNLQLAKRVELLQDELALSEPRGKKNKKSGESSSQLSQEQKSVFDEDLQKKIEENERLHIQFFEADEQHKHVEAELRSRLATLETEAAQHQAVVDGLTRKYMETIEKLQNDKAKLEVKSQTLEKEAKECRLRTEECQLQLKTLHEDLSGRLEESLSIINEKVPFNDTKYSQYNALNVPLHNRRHQLKMRDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKPLLESVPYEEALANRRILLSSTESREGLAQQVQQSLEKISKLEQEKEHWMLEAQLAKIKLEKENQRIADKLKNTGSAQLVGLAQENAAVSNTAGQDEATAKAVLEPIQSTSLIGTLTRTSDSEVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 15268 - protein, 738 aa, Homo sapiens
MASAELQGKYQKLAQEYSKLRAQNQVLKKGVVDEQANSAALKEQLKMKDQSLRKLQQEMDSLTFRNLQLAKRVELLQDELALSEPRGKKNKKSGESSSQLSQEQKSVFDEDLQKKIEENERLHIQFFEADEQHKHVEAELRSRLATLETEAAQHQAVVDGLTRKYMETIEKLQNDKAKLEVKSQTLEKEAKECRLRTEECQLQLKTLHEDLSGRLEESLSIINEKVPFNDTKYSQYNALNVPLHNRRHQLKMRDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKVQQSLEKISKLEQEKEHWMLEAQLAKIKLEKENQRIADKLKNTGSAQLVGLAQENAAVSNTAGQDEATAKAVLEPIQSTSLVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 15269 - protein, 154 aa, Homo sapiens
MPSRTARYARYSPRQRRRRMLADRSVRFPNDVLFLDHIRQGDLEQVGRFIRTRKVSLATIHPSGLAALHEAVLSGNLECVKLLVKYGADIHQRDEAGWTPLHIACSDGYPDIARYLISLGADRDATNDDGDLPSDLIDPDYKELVELFKGTTMD

SEQ ID NO: 15270 - protein, 425 aa, Homo sapiens
MMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGPRFMTSEYNSKYLRDPLDQPDFLQKKSIGAKEGSGFTKQSHQSPIVFQPPSQALPGDPALLPGQSVTKSDFLPKTHLHGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 15271 - protein, 405 aa, Homo sapiens
MMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGPRFMTSEYNSKYLRDPLDQPDFLQKKSIGAKEGSGFTKQSHQSPIVFQPPSQALPGDPGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 15272 - protein, 253 aa, Homo sapiens
MMMGCGESELKSADGEEAAAVPGPPPEPQVPQLRAPVPEPGLDLSLSPRPDSPQPRHGSPGRRKGRAERRGAARQRRQVRFRLTPPSPVRSEPQPAVPQELEMPVLKSSLALGLELRAAAGSHFDAAKAVEEQLRKSFQIRCGLEESVSEGLNVPRSKRLFRDLVSLQVPEEQVLNAALREKLALLPPQARAPHPKEPPGPGPDMTILCDPETLFYESPHLTLDGLPPLRLQLRPRPSEDTFLMHRTLRRWEA

SEQ ID NO: 15273 - protein, 422 aa, Homo sapiens
MYRVPEFYARRKRLGGQTPYLMDQLGLRLGMWYWKDETRTLEFRRFAAEDSVQWLLKHHPHFTPAAEVKEKGKKGKAVHFAETDGPASDRLTDKRLAAKDDKSAKAVEKRGQQGTITLDDVKFVTLLLLQDTEMQRICSFTTFMRNKNLDNFLMALLYYLSHYLEKNSLEKKPKSYMVGLVEKKEMELVLSELEAAQRYLAQKYCILVLGLAVPDKHHMCCGKEKISDTQKDWKFFESFYTFCTYVAWIVFRRQHLTEIEEEVGRLFRTNMFNIPRRRREDEESGGEKKRMTFVQFRRMMAKRPAIKKAINMRSPVMSTLLPSLREKAQNVFEKKYHQVDVRFPAEMQKHVGTLDSVPMPVVGILGEPRCLFNPHTLHPLDPEENTKSFGRYPSLMENNNMRIQDTLDLVMKTLSSHTSCPK

SEQ ID NO: 15274 - protein, 691 aa, Homo sapiens
MEIAPQEAPPVPGADGDIEEAPAEAGSPSPASPPADGRLKAAAKRVTFPSDEDIVSGAVEPKDPWRHAQNVTVDEVIGAYKQACQKLNCRQIPKLLRQLQEFTDLGHRLDCLDLKGEKLDYKTCEALEEVFKRLQFKVVDLEQTNLDEDGASALFDMIEYYESATHLNISFNKHIGTRGWQAAAHMMRKTSCLQYLDARNTPLLDHSAPFVARALRIRSSLAVLHLENASLSGRPLMLLATALKMNMNLRELYLADNKLNGLQDSAQLGNLLKFNCSLQILDLRNNHVLDSGLAYICEGLKEQRKGLVTLVLWNNQLTHTGMAFLGMTLPHTQSLETLNLGHNPIGNEGVRHLKNGLISNRSVLRLGLASTKLTCEGAVAVAEFIAESPRLLRLDLRENEIKTGGLMALSLALKVNHSLLRLDLDREPKKEAVKSFIETQKALLAEIQNGCKRNLVLAREREEKEQPPQLSASMPETTATEPQPDDEPAAGVQNGAPSPAPSPDSDSDSDSDGEEEEEEEGERDETPCPALVPPTDSLGPGDRSPPGSPSTPTEQRISVSSPGRGHKVFVVTRVESPPERAEPPASPTPPSPPPPPSPPASPSLPPAGAIDTRDTGSSEPQPPPEPPRSGPPLPNGLKPEFALALPPEPPPGPEVKGGSCGLEHELSCSKNEKELEELLLEASQESGQETL

SEQ ID NO: 15275 - protein, 687 aa, Homo sapiens
MEIAPQEAPPVPGADGDIEEAPAEAGSPSPASPPADGRLKAAAKRVTFPSDEDIVSGAVEPKDPWRHAQNVTVDEVIGAYKQACQKLNCRQIPKLLRQLQEFTDLGHRLDCLDLKGEKLDYKTCEALEEVFKRLQFKVVDLEQTNLDEDGASALFDMIEYYESATHLNISFNKHIGTRGWQAAAHMMRKTSCLQYLDARNTPLLDHSAPFVARALRIRSSLAVLHLENASLSGRPLMLLATALKMNMNLRELYLADNKLNGLQDSAQLGNLLKFNCSLQILDLRNNHVLDSGLAYICEGLKEQRKGLVTLVLWNNQLTHTGMAFLGMTLSLETLNLGHNPIGNEGVRHLKNGLISNRSVLRLGLASTKLTCEGAVAVAEFIAESPRLLRLDLRENEIKTGGLMALSLALKVNHSLLRLDLDREPKKEAVKSFIETQKALLAEIQNGCKRNLVLAREREEKEQPPQLSASMPETTATEPQPDDEPAAGVQNGAPSPAPSPDSDSDSDSDGEEEEEEEGERDETPCPALVPPTDSLGPGDRSPPGSPSTPTEQRISVSSPGRGHKVFVVTRVESPPERAEPPASPTPPSPPPPPSPPASPSLPPAGAIDTRDTGSSEPQPPPEPPRSGPPLPNGLKPEFALALPPEPPPGPEVKGGSCGLEHELSCSKNEKELEELLLEASQESGQETL

SEQ ID NO: 15276 - protein, 285 aa, Homo sapiens
MMAVDIEYRYNCMAPSLRQERFAFKISPKPSKPLRPCIQLSSKNEASGMVAPAVQEKKVKKRVSFADNQGLALTMVKVFSEFDDPLDMPFNITELLDNIVSLTTAESESFVLDFSQPSADYLDFRNRLQADHVCLENCVLKDKAIAGTVKVQNLAFEKTVKIRMTFDTWKSYTDFPCQYVKDTYAGSDRDTFSFDISLPEKIQSYERMEFAVYYECNGQTYWDSNRGKNYRIIRAELKSTQGMTKPHSGPDLGISFDQFGSPRCSYGLFPEWPSYLGYEKLGPYY

SEQ ID NO: 15277 - protein, 285 aa, Homo sapiens; identical to SEQ ID NO: 15276

SEQ ID NO: 15278 - protein, 228 aa, Homo sapiens
MVRLTLDLIARNSNLKPRKEETISQCLKKITHINFSDKNIDAIEDLSLCKNLSVLYLYDNCISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLGTYLY

SEQ ID NO: 15279 - protein, 355 aa, Homo sapiens
MVRLTLDLIARNSNLKPRKEETISQCLKKITHINFSDKNIDAIEDLSLCKNLSVLYLYDNCISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLEFLDGKEIKNIERQFLMNWKASKDAKKISKKRSSKNEDASNSLISNFKTMHHIVPVYYPQVGKPKLAFFSEIQRYPVNANASPESSCPFWPNIERKNLSLKQSESLLTKNDVHEPHLFHNPEEKENLFVENE

SEQ ID NO: 15280 - protein, 309 aa, Homo sapiens
MVRLTLDLIARNSNLKPRKEETISQCLKKITHINFSDKNIDAIEDLSLCKNLSVLYLYDNCISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLEFLDGKEIKNIERQFLMNWKASKDAKKISKKRSSKNEDASNSLISNFKTMHHIVPVYYPQVGKPKLAFFSEIQRYPVNANASPESS

SEQ ID NO: 15281 - protein, 414 aa, Homo sapiens
MDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 15282 - protein, 1150 aa, Homo sapiens
MAATYRLVVSTVNHYSSVVIDRRFEQAIHYCTGTCHTFTHGIDCIVVHHSVCADLLHIPVSQFKDADLNSMFLPHENGLSSAEGDYPQQAFTGIPRVKRGSTFQNTYNLKDIAGEAISFASGKIKEFSFEKLKNSNHAAYRKGRKVKSDSFNRRSVDLDLLCGHYNNDGNAPSFGLLRSSSVEEKPLSHRNSLDTNLTSMFLQNFSEEDLVTQILEKHKIDNFSSGTDIKMCLDILLKCSEDLKKCTDIIKQCIKKKSGSSISEGSGNDTISSSETVYMNVMTRLASYLKKLPFEFMQSGNNEALDLTELISNMPSLQLTPFSPVFGTEQPPKYEDVVQLSASDSGRFQTIELQNDKPNSRKMDTVQSIPNNSTNSLYNLEVNDPRTLKAVQVQSQSLTMNPLENVSSDDLMETLYIEEESDGKKALDKGQKTENGPSHELLKVNEHRAEFPEHATHLKKCPTPMQNEIGKIFEKSFVNLPKEDCKSKVSKFEEGDQRDFTNSSSQEEIDKLLMDLESFSQKMETSLREPLAKGKNSNFLNSHSQLTGQTLVDLEPKSKVSSPIEKVSPSCLTRIIETNGHKIEEEDRALLLRILESIEDFAQELVECKSSRGSLSQEKEMMQILQETLTTSSQANLSVCRSPVGDKAKDTTSAVLIQQTPEVIKIQNKPEKKPGTPLPPPATSPSSPRPLSPVPHVNNVVNAPLSINIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 15283 - protein, 529 aa, Homo sapiens
MMIKETSLRRDPDLRGELAFLARGCDFVLPSRFKKRLKSFQQTQIQNKPEKKPGTPLPPPATSPSSPRPLSPVPHVNNVVNAPLSINIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 15284 - protein, 161 aa, Homo sapiens
MDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQSNEDLAKLAVHDGYTNIFLF

SEQ ID NO: 15285 - protein, 630 aa, Homo sapiens
MSTNNALRVFWKSREWNMKTSTFDSDEDILLLPKRKRFRKKKSRPVRHTKRHEEEQVYEQGTTLPCSICKHEIDLTGIFLHKKQHVALATLGFQWMGRKKPQPSVIAVQRQFMISKLLSSFMFTEKTLQSINNAFELLWKKQIPAYYKIFDNIDRSVIYSQKICHLLIKGVGICEDRNSTWKADMNDKFTVVSNFGNKPNVCFFGLFDGHHGASAAELTSMELPVLLLHQLSKFDPSYQMTTDEQQIINSFYTVFREEYAAIEDLFSAINKTEAVRCEYEDTHKAFAKAFWRMDRLLGLGRKEVSRVQWSGCSAVTCILEGKPKSPYAHKNWKRKNTHDGLAESSPSQEMPKIISGILHVANTGNVQAVLCRNGKGFCLTKEHTTRNTNERRRILQNGAVISSNEPYGLVEGQVKTTRGLGFHGNLKLKKSIIPAPQTISVPIDDLCQFLIVATNGLWEVLDKEEVTALAMTTFHMYKETYCPIIPNKSPSKGPLLFSTSEPNLTKSQSNIHVLFQYKSVSEVRVSTTNSKENLSDSNYSKYCIYNPENVETFPAETTHRKPCSEKVTDRPTSVNDVATNEKESDTKSFYEGAAEYVSHELVNAALLAGSRDNITVMVIFLNGSEYQLLT

SEQ ID NO: 15286 - protein, 415 aa, Homo sapiens
MAEIPLYFVDLQDDLDDYGFEDYGTDCDNMRVTAFLDIPGQDNLPPLTRLEKYAFSENTFNRQIIARGLLDIFRDFGNNEEDFLTVMEIVVRLSEDAEPTVRTELMEQIPPIAIFLQENRSNFPVVLSEYLIPIVVRYLTDPNNQIICKMASMLSKSTVERLLLPRFCELCGDRKLFQVRKVCAANFGDICHAVGQEATEKFLIPKFFELCSDAVWGMRKACAECFTAVSHSSSPGVRRTQLFPLFIRLVSDPCRWVHQAAFQSLGPFTSTFANPSRAGLYLREDGALSIWPLTQDLDSGFASGSPAPSSGGNTSPASLTRSAKPVRSEPELPVEGTSAKTSDCPHSSSSSDGPAESPVESCVSAGAEWTRVSPETSACSKLSDMNDLPISSYPGSDSWACPGNTEDVFSHFLYW

SEQ ID NO: 15287 - protein, 454 aa, Homo sapiens
MSSGAPQKSSPMASGAEETPGFLDTLLQDFPALLNPEDPLPWKAPGTVLSQEEVEGELAELAMGFLGSRKAPPPLAAALAHEAVSQLLQTDLSEFRKLPREEEEEEEDDDEEEKAPVTLLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 15288 - protein, 361 aa, Homo sapiens
MSSGAPQKSSPMASGAEETPGFLDTLLQDFPALLNPEDPLPWKAPGTVLSQEEVEGELAELAMGFLGSRKAPPPLAAALAHEAVSQLLQTDLSEFRKLPREEEEEEEDDDEEEKAPVTLLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGESQRGRPKWEKVSRKPRPRVWPAAHQGFREAV

SEQ ID NO: 15289 - protein, 286 aa, Homo sapiens
MEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 15290 - protein, 286 aa, Homo sapiens; identical to SEQ ID NO: 15289

SEQ ID NO: 15291 - protein, 350 aa, Homo sapiens
MGLCPSTRETAPPAVLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 15292 - protein, 514 aa, Homo sapiens
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 15293 - protein, 340 aa, Homo sapiens
MEDAHCTWLSLPGLPPGWALFAVLDGHGGARAARFGARHLPGHVLQELGPEPSEPEGVREALRRAFLSADERLRSLWPRVETGGCTAVVLLVSPRFLYLAHCGDSRAVLSRAGAVAFSTEDHRPLRPRERERIHAAGGTIRRRRVEGSLAVSRALGDFTYKEAPGRPPELQLVSAEPEVAALARQAEDEFMLLASDGVWDTVSGAALAGLVASRLRLGLAPELLCAQLLDTCLCKVLGAWRGTFGAWCSRGREPRGFGEEGFDREARVKLAKEGIGLKRRAWPEVGRAKIQGRSLRDALRHGRVSGRDLRERAWSFGKGRFWVVGAGPEVLISAGRWKSR

SEQ ID NO: 15294 - protein, 430 aa, Homo sapiens
MAVLARQLQRLLWTACKKKEREKEGREEEEEEEAGRRAPEGPRSLLTAPRRAQRPHGGAEASGGLRFGASAAQGWRARMEDAHCTWLSLPGLPPGWALFAVLDGHGGARAARFGARHLPGHVLQELGPEPSEPEGVREALRRAFLSADERLRSLWPRVETGGCTAVVLLVSPRFLYLAHCGDSRAVLSRAGAVAFSTEDHRPLRPRERERIHAAGGTIRRRRVEGSLAVSRALGDFTYKEAPGRPPELQLVSAEPEVAALARQAEDEFMLLASDGVWDTVSGAALAGLVASRLRLGLAPELLCAQLLDTCLCKGSLDNMTCILVCFPGAPRPSEEAIRRELALDAALGCRIAELCASAQKPPSLNTVFRTLASEDIPDLPPGGGLDCKATVIAEVYSQICQVSEECGEKGQDGAGKSNPTHLGSALDMEA

SEQ ID NO: 15295 - protein, 402 aa, Homo sapiens
MAETSEEVAVLVQRVVKDITNAFRRNPHIDEIGLIPCPEARYNRSPIVLVENKLGVESWCVKFLLPYVHNKLLLYRTRKQWLNRDELIDVTCTLLLLNPDFTTAWNVRKELILSGTLNPIKDLHLGKLALTKFPKSPETWIHRRWVLQQLIQETSLPSFVTKGNLGTIPTERAQRLIQEEMEVCGEAAGRYPSNYNAWSHRIWVLQHLAKLDVKILLDELSSTKHWASMHVSDHSGFHYRQFLLKSLISQTVIDSSVMEQNPLRSEPALVPPKDEEAAVSTEEPRINLPHLLEEEVEFSTDLIDSYPGHETLWCHRRHIFYLQHHLNAGSQLSQAMEVDGLNDSSKQGYSQETKRLKRTPVPDSLGLEMEHRFIDQVLSTCRNVEQARFASAYRKWLVTLSQ

SEQ ID NO: 15296 - protein, 385 aa, Homo sapiens
MGCGASRKVVPGPPALAWAKHEGQNQAGVGGAGPGPEAAAQAAQRIQVARFRAKFDPRVLARYDIKALIGTGSFSRVVRVEQKTTKKPFAIKVMETREREGREACVSELSVLRRVSHRYIVQLMEIFETEDQVYMVMELATGGELFDRLIAQGSFTERDAVRILQMVADGIRYLHALQITHRNLKPENLLYYHPGEESKILITDFGLAYSGKKSGDWTMKTLCGTPEYIAPEVLLRKPYTSAVDMWALGVITYALLSGFLPFDDESQTRLYRKILKGKYNYTGEPWPSISHLAKDFIDKLLILEAGHRMSAGQALDHPWVITMAAGSSMKNLQRAISRNLMQRASPHSQSPGSAQSSKSHYSHKSRHMWSKRNLRIVESPLSALL

SEQ ID NO: 15297 - protein, 754 aa, Homo sapiens
MAAGVLPQNEQPYSTLVNNSECVANMKGNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQKELNSRDGAWERICGERDPFILCSLMWSWVEQLKEPVITKEDVDMLVDRRADAAEALFLLEKGQHQTILCVLHCIVNLQTIPVDVEEAFLAHAIKAFTKVNFDSENGPTVYNTLKKIFKHTLEEKRKMTKDGPKPGL

SEQ ID NO: 15298 - protein, 806 aa, Homo sapiens
MQVQDATRRPSAVRFLSSFLQGRRHSTSDPVLRLQQARRGSGLGSGSATKLLSSSSLQVMVAVSSVSHAEGNPTFPERKRNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQKELNSRDGAWERICGERDPFILCSLMWSWVEQLKEPVITKEDVDMLVDRRADAAEALFLLEKGQHQTILCVLHCIVNLQTIPVDVEEAFLAHAIKAFTKVNFDSENGPTVYNTLKKIFKHTLEEKRKMTKDGPKPGL

SEQ ID NO: 15299 - protein, 145 aa, Homo sapiens
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 15300 - protein, 226 aa, Homo sapiens
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 15301 - protein, 339 aa, Homo sapiens
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 15302 - protein, 378 aa, Homo sapiens
SFSPRLCSVNDYEGNDSEAEDLNFREALPSSSQENTPRSKVFENKVNSEKVKLSLRNFPHNDYEDVFEEPSESGSDPSMWTARGPFGRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSVSV

SEQ ID NO: 15303 - protein, 92 aa, Homo sapiens
  MOD_RES (1)..(1): Any amino acid
XGPNWRGCWGCSGTVGAAPQAQVFENKVNSEKVKLSLRNFPHNDYEDVFEEPSESGSDPSMWTARGPFGRDRWSSEDEEAAGPSQALSPLLS

SEQ ID NO: 15304 - protein, 113 aa, Homo sapiens
MSSPRDFRAESVNDYEGNDSEAEDLNFREALPSSSQENTPRSKVFENKVNSEKVKLSLRNFPHNDYEDVFEEPSESGSDPSMWTARGPFGRDRWSSEDEEAAGPSQALSPLLS

SEQ ID NO: 15305 - protein, 307 aa, Homo sapiens
MENQVLTPHVYWAQRHRELYLRVELSDVQNPAISITENVLHFKAQGHGAKGDNVYEFHLEFLDLVKPEEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 15306 - protein, 643 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGDDRFGRRVVTFSCCRMPPSHELDHQRLLEYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 15307 - protein, 564 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 15308 - protein, 504 aa, Homo sapiens
  MOD_RES (1)..(1): Any amino acid
XLGSFFTEYLQNQLLTKGMVILRDKIRFYEELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITSLPLAPLELSREPHALPGVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 15309 - protein, 529 aa, Homo sapiens
MFPLTEENKHVAQLLLNTGTCPRCIFRFCGVDFHAPYKLPYKELLNELQKFLETEKDELILEVMNPPPKKIRLQELEDSIDNLSQNGEGRISVSHVGSTASKNSNLNVCNVCLGILQEFCEKDFIKKVCQKVEASGFEFTSLVFSVSFPPQLSVREHAAWLLVKQEMGKQSLSLGRDDIVQLKEAYKWITHPLFSEELGVPIDGKSLFEVSVVFAHPETVEDCHFLAAICPDCFKPAKNKQSVFTRMAVMKALNKIKEEDFLKQFPCPPNSPKAVCAVLEIECAHGAVFVAGRYNKYSRNLPQTPWIIDGERKLESSVEELISDHLLAVFKAESFNFSSSGREDVDVRTLGNGRPFAIELVNPHRVHFTSQEIKELQQKINNSSNKIQVRDLQLVTREAIGHMKEGEEEKTKTYSALIWTNKAIQKKDIEFLNDIKDLKIDQKTPLRVLHRRPLAVRARVIHFMETQYVDEHHFRLHLKTQAGTYIKEFVHGDFGRTKPNIGSLMNVTADILELDVESVDVDWPPALDD

SEQ ID NO: 15310 - protein, 529 aa, Homo sapiens; identical to SEQ ID NO: 15309

SEQ ID NO: 15311 - protein, 120 aa, Homo sapiens
MFPLTEENKHVAQLLLNTGTCPRCIFRFCGVDFHAPYKLPYKELLNELQKFLETEKDELILEVMNPPPKKIRLQELEDSIDNLSQNGEGRISVSHVGSTASKNSNLNVCNVCLGILQEFC

SEQ ID NO: 15312 - protein, 661 aa, Homo sapiens
MEMTEMTGVSLKRGALVVEDNDSGVPVEETKKQKLSECSLTKGQDGLQNDFLSISEDVPRPPDTVSTGKGGKNSEAQLEDEEEEEEDGLSEECEEEESESFADMMKHGLTEADVGITKFVSSHQGFSGILKERYSDFVVHEIGKDGRISHLNDLSIPVDEEDPSEDIFTVLTAEEKQRLEELQLFKNKETSVAIEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMGTKDKRAITVQEIAVLKITAQRLAHLNKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRCVEGQLLRGLSKYGMKNIVSAFGIIPRNNRLMYIHSYQSYVWNNMVSKRIEDYGLKPVPGDLVLKGATATYIEEDDVNNYSIHDVVMPLPGFDVIYPKHKIQEAYREMLTADNLDIDNMRHKIRDYSLSGAYRKIIIRPQNVSWEVVAYDDPKIPLFNTDVDNLEGKTPPVFASEGKYRALKMDFSLPPSTYATMAIREVLKMDTSIKNQTQLNTTWLR

SEQ ID NO: 15313 - protein, 661 aa, Homo sapiens; identical to SEQ ID NO: 15312

SEQ ID NO: 15314 - protein, 661 aa, Homo sapiens; identical to SEQ ID NO: 15312

SEQ ID NO: 15315 - protein, 701 aa, Homo sapiens
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFPNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 15316 - protein, 701 aa, Homo sapiens; identical to SEQ ID NO: 15315

SEQ ID NO: 15317 - protein, 126 aa, Homo sapiens
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLS

SEQ ID NO: 15318 - protein, 701 aa, Homo sapiens; identical to SEQ ID NO: 15315

SEQ ID NO: 15319 - protein, 365 aa, Homo sapiens
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEI

SEQ ID NO: 15320 - protein, 303 aa, Homo sapiens
MSSAPASGSVRARYLVYFQYVGTDFNGVAAVRGTQRAVGVQNYLEEAAERLNSVEPVRFTISSRTDAGVHALSNAAHLDVQRRSGRPPFPPEVLAEALNTHLRHPAIRVLRAFRVPSDFHARHAATSRTYLYRLATGCHRRDELPVFERNLCWTLPADCLDMVAMQEAAQHLLGTHDFSAFQSAGSPVPSPVRTLRRVSVSPGQASPLVTPEESRKLRFWNLEFESQSFLYRQVRRMTAVLVAVGLGALAPAQVKTILESQDPLGKHQTRVAPAHGLFLKSVLYGNLGAASCTLQGPQFGSHG

SEQ ID NO: 15321 - protein, 71 aa, Homo sapiens
MGATGLGFLLSWRQDNLNGTDCQGCNILYFSETTGSMCSELSLNRGLEARRKKDLKDSFLWRDGVSPCLPC

SEQ ID NO: 15322 - protein, 147 aa, Homo sapiens
MGATGLGFLLSWRQDNLNGTDCQGCNILYFSETTGSMCSELSLNRGLEARRKKDLKDSFLWRYGKVGCISLPLREMTAWINPPQISEIFQGYHQRVHGADALSLQTNSLRSRLSSQCLGQSFLLRTLERGRGFRALGDICGHVHEED

SEQ ID NO: 15323 - protein, 147 aa, Homo sapiens; identical to SEQ ID NO: 15322

SEQ ID NO: 15324 - protein, 71 aa, Homo sapiens; identical to SEQ ID NO: 15321

SEQ ID NO: 15325 - protein, 733 aa, Homo sapiens
MGKLITRMWKLLRRRSAPKELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 15326 - protein, 718 aa, Homo sapiens
MLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 15327 - protein, 876 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 15328 - protein, 70 aa, Homo sapiens
MASDASHALEAALEQMDGIIAGTKTGADLSDGTCEPGLASPASYMNPFPVLHLIEDLRLALEMLELPQER

SEQ ID NO: 15329 - protein, 89 aa, Homo sapiens
MASDASHALEAALEQMDGIIAGTKTGADLSDGTCEPGLASPASYMNPFPVLHLIEDLRLALEMLELPQERAALLSQIPGPTAAYIKEWF

SEQ ID NO: 15330 - protein, 170 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSL

SEQ ID NO: 15331 - protein, 89 aa, Homo sapiens; identical to SEQ ID NO: 15329

SEQ ID NO: 15332 - protein, 217 aa, Homo sapiens
MLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 15333 - protein, 400 aa, Homo sapiens
MLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQGLQWLPGPQPP

SEQ ID NO: 15334 - protein, 758 aa, Homo sapiens
MDGDIDVYKHFSWLKRSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTRWDRLADALVTCPLCTLRAHSNTVCVTI

SEQ ID NO: 15335 - protein, 136 aa, Homo sapiens
MMDQEEKTEEGSGPCAEAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 15336 - protein, 68 aa, Homo sapiens
MSELNTKTSPATNQAAGQEEKGKAGNVKKAEEEEEIDIDLTAPETEKAALAIQGKFRRFQKRKKDPSS

SEQ ID NO: 15337 - protein, 478 aa, Homo sapiens
MWLAAAAPSLARRLLFLGPPPPPLLLLVFSRSSRRRLHSLGLAAMPEKRPFERLPADVSPINCSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVTSTYLVAFVVGEYDFVETRSKDGVCVCVYTPVGKAEQGKFAIEVAAKTLPFYKDYFNVPYPLPKIDLIAIADFAAGAMENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAAAGNL

SEQ ID NO: 15338 - protein, 324 aa, Homo sapiens
MKGFYRSKYTTPSGEVRYAAVTQFEATDARRAFPCWDEPAIKATFDISLVVPKDRVALSNMNVIDRKPYPDDENLVEVKFARTPVTSTYLVAFVVGEYDFVETRSKDGVCVCVYTPVGKAEQGKFAIEVAAKTLPFYKDYFNVPYPLPKIDLIAIADFAAGAMENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAAAGWTW

SEQ ID NO: 15339 - protein, 242 aa, Homo sapiens
LVKTAKLGTSWNYLFDFHPHRVLVVGAFANFCTEPTGCSCLFPKLPPHLLMLPCWFHLLFFQDYIMSGASALPPGLVSFVKAPLPQWWPGGCPGVGGPLQALEAKPGQLSLPIRNQKRLVKSALELGENELFQQFPNPQSSWVQRTQEALRPLLSVALQLFLGRRGLPLPFRAPIRTVVGSAIPVQQSPPPSPAQVDTLQARYVGRLTQLFEEHQARYGVPADRHLVLTEARPTAWPRLSAG

SEQ ID NO: 15340 - protein, 472 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYQLDDPSCPRPECYRSCGSSMPDEFPTDIPGTKGNFRLVRHVSFVDCPGHDILMATMLNGAAVMDAALLLIAGNESCPQPQTSEHLAAIEIMKLKHILILQNKIDLVKERQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQETEVRPGIVSKDSEGKLMCKSIFSKIVSLFAEHNDLQYAAPGGLIGVGTKIDPTLCRADRMVGQILGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 15341 - protein, 180 aa, Homo sapiens
MEEAGLCGLREKADMLCNSESHDILQHQDSNCSATSNKHLLEDEEGRDFITKNRSWVSPVHCTQESRRELPEQEVAPPSGQQALQQQEQRKSLRKRSFIIDASPKHFRLQRRSWQLSVRNMLILEIHLFYRRVCFELYDLKQNSFFGDYGNILNRETLLDFVKQIMEKIQNFLKNHGKFL

SEQ ID NO: 15342 - protein, 131 aa, Homo sapiens
MEEAGLCGLREKADMLCNSESHDILQHQDSNCSATSNKHLLEDEEGRDFITKNRSWVSPVHCTQESRRELPEQEVAPPSGQQALQCNRNKEKVLGKEVLLLMQALNTLSTPEEKLAALCKKYADLGNSPLL

SEQ ID NO: 15343 - protein, 140 aa, Homo sapiens
MEEAGLCGLREKADMLCNSESHDILQHQDSNCSATSNKHLLEDEEGRDFITKNRSWVSPVHCTQESRRELPEQEVAPPSGQQALQCNRNKEKVLGNNLCSVVGCCHILVFLFYIFCSMSDYELGLFGGKCCLVNLFLHLV

SEQ ID NO: 15344 - protein, 170 aa, Homo sapiens
  MOD_RES (1)..(1): Any amino acid
XTSWRRGEVTPRRGSGGGAKTIGAKQGRTQLSSGFVNSTMEEAGLCGLREKADMLCNSESHDILQHQDSNCSATSNKHLLEDEEGRDFITKNRSWVSPVHCTQESRRELPEQEVAPPSGQQALQCNRNKEKVLGKEVLLLMQALNTLSTPEEKLAALCKKYADLGNSPLL

SEQ ID NO: 15345 - protein, 131 aa, Homo sapiens
MEEAGLCGLREKADMLCNSESHDILQHQDSNCSATSNKHLLEDEEGRDFITKNRSWVSPVHCTQESRRELPEQEVAPPSGQQALQCNRNKEKVLERQGLSLSPRLERGGTFMGHGSLKLPELVILSLQTLE

SEQ ID NO: 15346 - protein, 181 aa, Homo sapiens
MKQEEAQLKEQLFLYMDKFEEFQTTMAKTNELFTAFKQETEKLTKKIKKLEKEMVIWYTKWENNNTTLLQMAEEKTIRDKNYKVFQIKLERLEKLYKALQIERNELSEKLGILKGQVSVKVADVDLAVPVTHSCADLDSSNMLNTSSKRAPGVHLEADPKGMNEVKCYSKALSTGSPLGID

SEQ ID NO: 15347 - protein, 181 aa, Homo sapiens; identical to SEQ ID NO: 15346

SEQ ID NO: 15348 - protein, 263 aa, Homo sapiens
MDRAKQQQALLLLPVCLALTFSLTAVVSSHWCEGTRRVVKPLCQDQPGGQHCIHFKRDNSSNGRMDNNSQAVLYIWELGDDKFIQRGFHVGLWQSCEESLNGEDEKCRSFRSVVPAEEQGVLWLSIGGEVLDIVLILTSAILLGSRVSCRSPGFHWLRVDALVAIFMVLAGLLGMVAHMMYTTIFQITVNLGPEDWKPQTWDYGWSYCLAWGSFALCLAVSVSAMSRFTAARLEFTEKQQAQNGSRHSQHSFLEPEASESIWK

SEQ ID NO: 15349 - protein, 295 aa, Homo sapiens
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEVKETETSTPSKKGWEAGSSLLGGEVPGQRQLPAWGLVTTAPRRAVLRLFLASCL

SEQ ID NO: 15350 - protein, 295 aa, Homo sapiens; identical to SEQ ID NO: 15349

SEQ ID NO: 15351 - protein, 239 aa, Homo sapiens
SATGFHREGPTSSATLKDLESPCQERAVVLDSTSVKISRLKNTIKSLICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEVKETETSTPSKKGWEAGSSLLGGEVPGQRQLPAWGLVTTAPRRAVLRLFLASCL

SEQ ID NO: 15352 - protein, 632 aa, Homo sapiens
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELESALSAVIATEKKKANQLSSCSKAHTEWELEQSLQDQALLKAQLTQLKESFQQLQLERDECAEHIEGERARWHQRMSKMSQEICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLSLMALPGEGHGGEHLDSEGEEAPQPMPSVPEDLESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 15353 - protein, 632 aa, Homo sapiens
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELESALSAVIATEKKKANQLSSCSKAHTEWELEQSLQDQALLKAQLTQLKESFQQLQLERDECAEHIEGERARWHQRMSKMSQEICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLSLMALPGEGHGGEHLDSEGEEAPRPMPSVPEDPESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 15354 - protein, 229 aa, Homo sapiens
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGGSTAWPWERVLSARSRGGPCPKTFILQWCSTWKRTRRSSSSDLMTRTFAALSCTATPLFSWCFTATGQTRVTVVGPPMAKQWLLLMFHCVGSQDSKCHARGLKMLERVRSQPLTNDDLVTSVSLPPYTGD

SEQ ID NO: 15355 - protein, 163 aa, Homo sapiens
MSSCPVHDCPSWDPERLEPVETGSRGALRLRGGAPGSAAGFRASIWGPAGYPSPVGLGHPASLPRPAYSPRCPEPDARHGWGSGSNAGYRGPDRAGTPCPAQDREGRSSSPVPPPRLKAMTSQARKQNGGALIDTVDWTREAPDSDPVMSMQKTQKPQTTVGQ

SEQ ID NO: 15356 - protein, 196 aa, Homo sapiens
MDHEAAQLEKQHVHNVYESTAPYFSDLQSKAWPRVRQFLQEQKPGSLIADIGCGTGKYLKVNSQVHTVGCDYCGPLVEIARNRGCEAMGLEHPWIWYPRASWNQPPTDIEGPQYFYPPCHPIPDLQKQTIICHFKGPTLNEQQKSSPTHHRLHACFQHCREEESRPWLMALSSWDQVAMEGHVSASLTSCIVRLLL

SEQ ID NO: 15357 - protein, 454 aa, Homo sapiens
MDHEAAQLEKQHVHNVYESTAPYFSDLQSKAWPRVRQFLQEQKPGSLIADIGCGTGKYLKVNSQVHTVGCDYCGPLVEIARNRGCEAMVCDNLNLPFRDEGFDAIISIGVIHHFSTKQRRIRAIKEMARVLVPGGQLMIYVWAMEQKNRHFEKQDVLVPWNRALCSQLFSESSQSGRKRQCGYPERGHPYHPPCSECSCSVCFKEQCGSKRSHSVGYEPAMARTCFANISKEGEEEYGFYSTLGKSFRSWFFSRSLDESTLRKQIERVRPLKNTEVWASSTVTVQPSRHSSLDFDHQEPFSTKGQSLDEEVFVESSSGKHLEWLRAPGTLKHLNGDHQGEMRRNGGGNFLDSTNTGVNCVDAGNIEDDNPSASKILRRISAVDSTDFNPDDTMSVEDPQTDVLDSTAFMRYYHVFREGELCSLLKENVSELRILSSGNDHGNWCIIAEKKRGCD

SEQ ID NO: 15358 - protein, 367 aa, Homo sapiens
MVCDNLNLPFRDEGFDAIISIGVIHHFSTKQRRIRAIKEMARVLVPGGQLMIYVWAMEQKNRHFEKQDVLVPWNRALCSQLFSESSQSGRKRQCGYPERGHPYHPPCSECSCSVCFKEQCGSKRSHSVGYEPAMARTCFANISKEGEEEYGFYSTLGKSFRSWFFSRSLDESTLRKQIERVRPLKNTEVWASSTVTVQPSRHSSLDFDHQEPFSTKGQSLDEEVFVESSSGKHLEWLRAPGTLKHLNGDHQGEMRRNGGGNFLDSTNTGVNCVDAGNIEDDNPSASKILRRISAVDSTDFNPDDTMSVEDPQTDVLDSTAFMRYYHVFREGELCSLLKENVSELRILSSGNDHGNWCIIAEKKRGCD

SEQ ID NO: 15359 - protein, 848 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECLLTPLPPSALPSAPPSADDNLKTRAECLLHPLPPSADDNLKTPSERQLTPLPPSAPPSADDNIKTPAFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHTQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 15360 - protein, 1138 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDKLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAFHPQRMIISRHLPSVSSLPFHPQLHPQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 15361 - protein, 992 aa, Homo sapiens
MFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDKLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKIPAERLRIPLPPSADDNLKTPSERQLTPLPPSAPPSADDNIKTPAFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHTQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 15362 - protein, 420 aa, Homo sapiens [sequence omitted]

SEQ ID NO: 15363 - protein, 661 aa, Homo sapiens
MFQRAQELRRRAEDYHKCKIPPSARKALCNWVRMAAAEHRHSSGLPYWPYLTAETLKNRMGHQPPPPTQQHSITDNSLSLKTPPECVLTPLPPSADDNLKTPPECVLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAFHPQRMIISRHLPSVSSLPFHPQLHSQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPKPKRRRVGDVEPSRKPKRRRAADVEPSSPEPKRRRVGDVEPSRKPKRRRAADVEPSSPEPKRRRLS

SEQ ID NO: 15364 - protein, 420 aa, Homo sapiens
MAAAEHRHSSGLPYWPYLTAETLKNRMGHQPPPPTQQHSITDNSLSLKTPPECVLTPLPPSADDNLKTPPECVLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPKPKRRRVGDVEPSRKPKRRRAADVEPSSPEPKRRRVGDVEPSRKPKRRRAADVEPSSPEPKRRRLS

SEQ ID NO: 15365 - protein, 834 aa, Homo sapiens
MKVIVIHRKMFQRAQELRRRAEDYHKCKIPPSARKALCNWVRMAAAEHRHSSGLPYWPYLTAETLKNRMGHQPPPPTQQHSITDNSLSLKTPPECVLTPLPPSADDNLKTPPECVLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSADDNIKTPAFHPQRMIISRHLPSVSSLPFHPQLHSQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPKPKRRRVGDVEPSRKPKRRRAADVEPSSPEPKRRRVGDVEPSRKPKRRRAADVEPSSPEPKRRRLS

SEQ ID NO: 15366 - protein, 196 aa, Homo sapiens [sequence omitted]

SEQ ID NO: 15367 - protein, 462 aa, Homo sapiens
MDSLWGPGAGSHPFGVHNTRLSPDLCPGKIVLRALKESGAGMPEQDKDPRVQENPGDQRRVPEVTGDAPSAFRPLRDNRGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLALRNDSSTSEASRPSTHKFPLLPRRRGEPLMLPPPLELGYRVTVEDLDREKEAAFQRINSALQVEDKAISDCRPSRPSHTLSSLATGTSGLPAISKAPSMDVQQETHKSQDCLGLLAPLASAAGVPSTAPMSGKKHKPPGPLFSSSDPLPATSSHSQDSAQVTSLIPAPFPAASMDVGMRRTRCGTSAPAAAAAAPPPSTLNPTLGSLLEWMEALHISGPQPQLQQVPRGQNQRSQTSRTSSCPKRNAISSPYRSTGGLPERKRRRGPASSHCQLNLSS

SEQ ID NO: 15368 - protein, 126 aa, Homo sapiens
MGRIFQLLRDRRISSRGPGLHTPKAEPRRRKGLTTGLMTQAERQKQAHQRQAAMRETALWCTGHIRPRTHTHTGTHTQTDRERERNTQRLRDRERRENGRHTHIHTQTHTQSLIAKALKDTHPGNP

SEQ ID NO: 15369 - protein, 464 aa, Homo sapiens
MMACRDPKPGAKRLVRAQTLQKQRRAPVGPRAPPPDEEDPRLKCKNCGAFGHMARSTRCPMKCWKAALVPPTLGKKEGKENLKPWKPQVEANPGPLNKDKGEKEERPRQQDPQRKALLHIFSGKPPEKPLPNRKGSTESSVYLRVASGPMPVHTTSKRPRVDPVLADRSATEMSDRGSALASLSPLRKASLSSSSSLGPKERQTGAAADIPQPAVRHQGPEPLLVVKPTHSSPEGGCREVPQAASKTHGLLQAISPQAQDKRPAVTSQPCPPAATHSLGLGSNLSFGPGAKRPAQAPIQACLNFPKKPRLGPFQIPESAIQGGELGAPEYLQPPPATTELGPSTSPQMGRRTPAQVSSVDRQPPHSRPCLPTAQACTMSHHPATSHDGAQPLRVLFRRLENGRWSSSLLAAPSFHSPEKPGAFLAQSPHVSEKSEVPRVRVPPNVLYEDLQVSSSSEDSDSDLE

SEQ ID NO: 15370 - protein, 460 aa, Homo sapiens
QMARHSVHHQAQRPPRAKNPQEQQRRPMGQTTLPAEQEESRVKCKNCGAFGHSARSKTCPIKRWSGALPLQALGSHKEKENLKPAKAQLPFTTPGPFTTNDREKERSPSPQQQQSEAPTQTFPRTPQEKMQEAWKEPAEDCLFLRHPTMPLPVHTTKKRSVLGPVSTGPPPVNKPEMRLLCPSGHNDSPQLSTCGPTKGHGRDVTASLLPVLKSSHQTPTLSARLPANRPDMSSHGALQPAMQALALGPGLKSQAEIKHPDADAKPRPQQVRKQCGQDSRTQAPDKEPAPVPTQTFQNPAKKARFSSFQTPALRTQLPDVGAVQTLQPPRTATGLGSKEAPKATAETAATKTATLQPRVNLQPAPSSPFLGPAQGCPVLQPGPPIHVPGRPGSVTFMRGDKGQKSPRFRMPPTSRPPENSASAQSPRFSRQPEGQGPQVSTSVLYEDLLVTSSSEDSDSD

SEQ ID NO: 15371 - protein, 297 aa, Homo sapiens
FVLGAVSPAVVVLYTMVLQENGYGVEEDIPTLLMAASSMDDLLAITGFNTCLSIVFYSGGMINNAIASLRNVCISLLAGIVLGFFVRYFPSEDQKKITLKRGFLVLITFVSAVLGSQPIGLHGSGGLCTLVLHFIEWTKWSQEKMKVQKIITNVWDIFQPLLFGLVGAEVSVSLLESNIVGISVSTLSLALCVRILNIYLLMCFAGFSFKEKIFIALAWMPKATVQAVLGPLALETARVSTPHLETYAKDVMTVAFLAIMITAPNGALLMGILGPKMLTRHYDPSKIKLQLSTLEHH

SEQ ID NO: 15372 - protein, 774 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 15373 - protein, 743 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 15374 - protein, 693 aa, Homo sapiens
SLPQSEAQGQAVDLRTPVSCLRGRLPPGHTEARLVGGEHPCAGRLEVTWGTVCDAALDLATAHVVCRELQCGAVVSTPEGARFGRGSGPVWTEAFRCAGNESLLFHCPRGRGSQCGHGHDAGLRCSEFRMVNGSSSCEGRVEFQVQGSWAPLCATHWDIADATVLCHQLNCGNAVAAPGGGHFGDGDAAIWPDAFHCEGTESYLWNCPVSTLGAPACAPGNTASAVCSGLAHALRLREGQSRCDGRVEVSLDGVWGRVLDDAWDLRGAGVVCRQLGCRGAQQAYDAPAPSRGSVQVALSRVRCLGTETRLTQCNVSATLQEPAGTSRDAGVVCSGEVGTASPMARRHGIPGALTLSLHREPQGAAGRGAGALHGGAWGTVCDDAWDLRDAHVVCRQLGCGRALSPGGRTLRSRGRAHLAGRAGLPGPRVCAVAVPVGGLGAARLEAQGGRRRLLLRVGGSEAARWDLLLCWVAGRVLQWDLGRHVQQCPEGPLLVHHLQAAGVWGVGLAGEQALPLCGHRDRLGGQHRVPQAAQLHSVAMPFPPMAPALLRPSRAGLDYLCRIVRGQATGCWGAPQLLLLARLPRGGRTARARGRGPLLRARGALARGLLGHRVRRWLGPGGRGGRVPPAGLWSGRRRPGGRRLWPWLRARVAGRGGVPGQRGVPVGLPRSGGDAETARTRRTRACAAGKTNS

SEQ ID NO: 15375 - protein, 452 aa, Homo sapiens
MNSGILQVFQRELICPICMNYFIDPVTIDCGHSFCRPCFYLNWKDSPFLVQCSECTKSTGQINLKTNIHFKKMASLARKVSLWLFLSSEEQMCGTHRETKKMFCEVDRSLLCLLCSSSQEHRDHRHCPIESAAEEHQEKLLQKMQSLWEKACENHRNLNVETTRTRCWKDYVNLRLEAIRAEYQKMPAFHHEEEKHNLEMLKKKGKDIFHRLHLSKAKMAHRREILRGMYEELNEMCHKPDVELLQAFGDILHRSESVLLHMPQPLNPELSAGPITGLRDRLNQFRVHITLHHEEANSDIFLCEILRSMCIGCDHQDVPYFTATPRSFLAWGAQTFTSGKYYWEVHVGDSWNWAFGVCNMYWKEKNQNEKIDGEDGLFLLGCVKNDIQRSLFTTSPLLLQYIPRPTSRVGLFLDCEAKTVSFVDVNQSSLIYTIPNCSFSPPLRPIFCCIHF

SEQ ID NO: 15376 - protein, 112 aa, Homo sapiens
QVAYVRARELHTLEVTGLETVAQSKAHVASLEGLIPEDKVVLLAGSPLQNEATLGQCGVEALTTLEVVGRRLGGNNCLSLQVNPVQPARYLWTTLHSSKQGEPNSSANHRCS

SEQ ID NO: 15377 - protein, 341 aa, Homo sapiens
MRLCLIPRNTGTPQRVLRPVVWSPPSRKKPVLSPHNSIMFGHLSPVRIPCLRGKFNLQLPSLDDQVIPARLPKTEVSAEEPKEATEVKDQVETQGQEDNKRGPCSNGEAASTSRPLETQGNLTSSWYNPRPLEGNVHLKSLTEKNQTDKAQVHAVSFYSKGHGVASSHSPAGGILPFGKPDPLPTVLPAPVPGCSLWPEKAALKVLGEDHLPSSPGLLMVGEDMQPKDPAALGSSRSSPPRAAGHRSHKRKLSGPPLQLQPTPPLQLRCDRDERPPPAKLPCLSPEALLVGQASQREGRLQHGNMRKNMRVLSRISKFRRLRQLLRRRKKTRQGRRGGSCL

SEQ ID NO: 15378 - protein, 94 aa, Homo sapiens
MRKLRLRASNPGPSGAPGTRQHFSTSRGGHHCARRWLRRVRRSRSQTPSYQNLDPNPPIVRFPLPLERISEVPRRACLHGRDASSVWPPPERSD

SEQ ID NO: 15379 - protein, 755 aa, Homo sapiens
MAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAGEAPSENQSPSKGPEEASSEVQDTNEVHVPGDQDEPQTLGKKGSKNNISVYMTLNQKKSDSSSASVCSIDSTDDLKSSNSECSSSESFDFPPGSMHAPSTSSTSSSSKEEKKLSNSLKMKVFSKNVSKCVTPDGRTICVGDIVWAKIYGFPWWPARILTITVSRKDNGLLVRQEARISWFGSPTTSFLALSQLSPFLENFQSRFNKKRKGLYRKAITEAAKAAKQLTPEVRALLTQFET

SEQ ID NO: 15380 - protein, 560 aa, Homo sapiens
MAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAGLNKWQLLHQTVTSPAAPLQCLTDHCGFRLGALKLTVKRAAQRH

SEQ ID NO: 15381 - protein, 520 aa, Homo sapiens
MAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAAQRH

SEQ ID NO: 15382 - protein, 590 aa, Homo sapiens
MEPRAGCRLPVRVEQVVNGALVVTVSCGERSFAGILLDCTKKSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGKIHGFPWWPARVLDISLGQKEDGEPSWREAKVSWFGSPTTSFLSISKLSPFSEFFKLRFNRKKKGMYRKAITEAANAARHVAPEIRELLTQFET

SEQ ID NO: 15383 - protein, 499 aa, Homo sapiens
MEPRAGCRLPVRVEQVVNGALVVTVSCGERSFAGILLDCTKKSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGHRR

SEQ ID NO: 15384 - protein, 179 aa, Homo sapiens
  MOD_RES (1)..(1): Any amino acid
XQSRRIEPVMGRLLLCASHGEIEKHPSLHASSYGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQQLGVDPTEHLFENGSEFPSELEDGDDPAAYVTNLSYYHLVPFETDIWD

SEQ ID NO: 15385 - protein, 231 aa, Homo sapiens
MASAVFEGTSLVNMFVRGCWVNGIRRLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQQLGVDPTEHLFENGSEFPSELEDGDDPAAYVTNLSYYHLVPFETDIWD

SEQ ID NO: 15386 - protein, 500 aa, Homo sapiens
MEAARPPPTAGKFVVVGGGIAGVTCAEQLATHFPSEDILLVTASPVIKAVTNFKQISKILEEFDVEEQSSTMLGKRFPNIKVIESGVKQLKSEEHCIVTEDGNQHVYKKLCLCAGAKPKLICEGNPYVLGIRDTDSAQEFQKQLTKAKRIMIIGNGGIALELVYEIEGCEVIWAIKDKAIGNTFFDAGAAEFLTSKLIAEKSEAKIAHKRTRYTTEGRKKEARSKSKADNVGSALGPDWHEGLNLKGTKEFSHKIHLETMCEVKKIYLQDEFRILKKKSFTFPRDHKSVTADTEMWPVYVELTNEKIYGCDFIVSATGVTPNVEPFLHGNSFDLGEDGGLKVDDHMHTSLPDIYAAGDICTTSWQLSPVWQQMRLWTQARQMGWYAAKCMAAASSGDSIDMDFSFELFAHVTKFFNYKVVLLGKYNAQGLGSDHELMLRCTKGREYIKVVMQNGRMMGAVLIGETDLEETFENLILNQMNLSSYGEDLLDPNIDIEDYFD

SEQ ID NO: 15387 - protein, 139 aa, Homo sapiens
MEAARPPPTAGKFVVVGGGIAGVTCAEQLATHFPSEDILLVTASPVIKAVTNFKQISKILEEFDVEEQSSTMLGKRFPNIKVIESGVKQLKSEEHCIVTEDGNQHVYKKLCLCAGAKPKLICEGNPYVLGIRDTDSAQV

SEQ ID NO: 15388 - protein, 581 aa, Homo sapiens
MAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKKHGLRLHLRNPYSFTPMLEEGAGSKVPRCLLLGTDMAENQKQIAQFSQKDAQVFPKYEEFMHRLALAIDPLLDAAPVDMAAFQHGSLLQRMRSLSTLKPLLKAGRILGAQLPRYYEVLTAPITKVLDQWFESEPLKATLATDAVIGAMTSPHTPGSGYVLLHHVMGGLEGMQGAWGYVQGGMGALSDAIASSATTHGASIFTEKTVAKVQVNSEGCVQGVVLEDGTEVRSKMVLSNTSPQITFLKLTPQEWLPEEFLERISQLDTRSPVTKINVAVDRLPSFLAAPNAPRGQPLPHHQCSIHLNCEDTLLLHQAFEDAMDGLPSHRPVIELCIPSSLDPTLAPPGCHVVSLFTQYMPYTLAGGKAWDEQERDAYADRVFDCIEVYAPGFKDSVVGRDILTPPDLERIFGLPGGNIFHCAMSLDQLYFARPVPLHSGYRCPLQGLYLCGSGAHPGGGVMGAAGRNAAHVAFRDLKSM

SEQ ID NO: 15389 - protein, 196 aa, Homo sapiens
MKPRTLVELSKLGLGNETVVQLRTLELPVDYREAKRRVTGIWEDHQPQLVVHVGMDTAAKAIILEQSGKNQGYRDADIRSFWPEGGVCLPGSPDVLESGVCMKAVCKRVAVEGVDVIFSRDAGRYVCDYTYYLSLHHGKGCAALIHVPPLSRGLPASLLGRALRVIIQEMLEEVGKPKHRAQFEENSTMVLPAKGN

SEQ ID NO: 15390 - protein, 142 aa, Homo sapiens
MDTAAKAIILEQSGKNQGYRDADIRSFWPEGGVCLPGSPDVLESGVCMKAVCKRVAVEGVDVIFSRDAGRYVCDYTYYLSLHHGKGCAALIHVPPLSRGLPASLLGRALRVIIQEMLEEVGKPKHRAQFEENSTMVLPAKGN

SEQ ID NO: 15391 - protein, 142 aa, Homo sapiens; identical to SEQ ID NO: 15390

SEQ ID NO: 15392 - protein, 286 aa, Homo sapiens
MGGERSGVRGNKMAAAEPSPRRVGFVGAGRMAGAIAQGLIRAGKVEAQHILASAPTDRNLCHFQALGCRTTHSNQEVLQSCLLVIFATKPHVLPAVLAEVAPVVTTEHILVSVAAGVSLSTLEELLPPNTRVLRVLPNLPCVVQEGAIVMARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 15393 - protein, 137 aa, Homo sapiens
MARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 15394 - protein, 253 aa, Homo sapiens
MTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 15395 - protein, 480 aa, Homo sapiens
MNMKASRVTLGEAGARARWPLGTPRAAATRREAAALPPVTLALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRRQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 15396 - protein, 253 aa, Homo sapiens; identical to SEQ ID NO: 15394

SEQ ID NO: 15397 - protein, 36 aa, Homo sapiens
MTQGTEDLKGPGQRCENEPLLDPVGPEPLGPESQSG

SEQ ID NO: 15398 - protein, 133 aa, Homo sapiens
MTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVV

SEQ ID NO: 15399 - protein, 96 aa, Homo sapiens
MTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQ

SEQ ID NO: 15400 - protein, 1099 aa, Homo sapiens
MRMSDTVTVKDETATMKDLEAEVKDTTRVENLIKSENYGKILVEKNEHCIENNIDLQRPLQSFGQTGKRSKSSSKLKLVRSLAVCEESPPPPAPEISQENQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 15401 - protein, 970 aa, Homo sapiens [sequence omitted]

SEQ ID NO: 15402 - protein, 268 aa, Homo sapiens
MVALENPECGPEAAEGTPGGRRLLPLPSCLPALASSQVKRLSASRRKQHFINQAVRNSDLVPKAKGRKSLQRLENTQYLLTLLETDGGLPGLEDGDLAPPASPGIFAEACNNATYVEVWNDFMNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 15403 - protein, 229 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDADINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 15404 - protein, 228 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDDINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 15405 - protein, 229 aa, Homo sapiens; identical to SEQ ID NO: 15403

SEQ ID NO: 15406 - protein, 185 aa, Homo sapiens
MLKAKILFVGPCESGKTVLANFLTESSDITEYSPTQGVRILEFENPHVTSNNKGTGCEFELWDCGGDAKFESCWPALMKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 15407 - protein, 185 aa, Homo sapiens; identical to SEQ ID NO: 15406

SEQ ID NO: 15408 - protein, 155 aa, Homo sapiens
MLKAKILFVGPCESGKTVLANFLTESSDITEYSPTQGVRFESCWPALMKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 15409 - protein, 108 aa, Homo sapiens
MKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 15410 - protein, 108 aa, Homo sapiens; identical to SEQ ID NO: 15409

SEQ ID NO: 15411 - protein, 356 aa, Homo sapiens
MDSSEEHAGCPARGTCPVFLAMSAGTVRYAPSGLCPVLEGNLREEPWGTDSPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 15412 - protein, 382 aa, Homo sapiens
MWSGPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 15413 - protein, 105 aa, Homo sapiens
MATQGPDKVIFLLVGHKSDLQSTRCVSAQEAEELAASLGMAFVETSVKNNCNVDLAFDTLADAIQQALQQGDIKLEEGWGGVRLIHKTQIPRSPSRKQHSGPCQC

SEQ ID NO: 15414 - protein, 154 aa, Homo sapiens
MAGGGPQANPDYLFHVIFLGDSNVGKTSFLHLLHQNSFATGLTATVLHPSLCVLGVDFRVKTLLVDNKCFVLQLWDTAGQERYHSMTRQLLRKADGVVLMYDITSQESFAHVRYWLDCLQDAGSDGVVILLLGNKMDCEEERQVSVEAGQQLAQ

SEQ ID NO: 15415 - protein, 216 aa, Homo sapiens
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 15416 - protein, 286 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 15417 - protein, 670 aa, Homo sapiens
MNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCRQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 15418 - protein, 670 aa, Homo sapiens; identical to SEQ ID NO: 15417

SEQ ID NO: 15419 - protein, 670 aa, Homo sapiens; identical to SEQ ID NO: 15417

SEQ ID NO: 15420 - protein, 1159 aa, Homo sapiens
MSLPQPTPRMAELRKPTSSLTPPEDPDSQPPSSKRLCLEEPGGVFKAGWRLPLVPRLSEAEKVWELSPRPFKGLLVSTNAIFDNSTDSCVEKSVSGKQICNLKCSNLKFQMSSCLQSPPSQSPDSDLRASGRSEAGLHDREAFSVHRSNSSKAGVSQLLPSTSIHDIHGIRNENRKQQFVQGRDNVHKENPFLDVTFYKETKSPFHEIKNRCKANSVVPSNKRENNISSSVLKISKSQNQPSLEIAKPSYFRDSGTISVPQFPMDLNSKMSSVYLKEIAKKKNDKKEAYVRDFTNIYWSQNRPDVKKQKLQNDKKTVEAENIFSKCYENDYPSLSSQNTCKRKDLISSNYCNCSSIQCNVRDSRKNFAILENANWEEAECLDSYVLTRLEKSQNWDCNVRHILRRNRGNCWIINNCKTKCENMKKTEEKWNWLLLLEIDLLSKEDYHCAKVINAYEEQSKLLVREILGSQTALITTVWLNGKGENDNTLQLRYNTTQKVFHVNNPFESFIIEIFYFHKSISGNKKDNSILTCCNILKCKKQIGIIGIQNLITRNMNTNIKNGILSIYLQDSVSEPLDILLKTNIAFLLNNFDSLTRIENDFELEEECIFKCMLYLKYPKNIVENHTAYLVKILTSSRLLEDNMKPMLKKRKLFRTEQVFEKSKKKLINSFSMTTQNTGFPIFETYEKIPLLMDFDDMDEISLIREITCQNMSCPQQVVNVENWAHYNSSTVKAHGNSCPQFIQNNRGYINENFYEVNMHSQDLNMERKQGHNKISNFDCEHIFEDLCNVRQQAIPASHNIIHNEETHTTSITQVLNFWNLLSEIEEKKYDLILKEEVKVTAESLTNSCQVHKDTKIEKEEKDSFFPMDDMFSVQSVSLISKEVNVEENKYVNQNYVTNTNEYESILPEREIANSKDFHRKNDSALYINHQFETGLSEGNDECFQDLAAKYLSTEALTIVKDFEMKRKFDLVLEELRMFHEISRENELLSTVETNNGQENYFGENDAEKVKMEIEKDLKMVVVNKIRASSSFHDTIAGPNMGKSHQSLFKWKTVPNNGEQEVPNESCYPSRSEEELLYSTSEKDCETPLPKRPAFLPDECKEEFNYLLRGGSHFPHGISRVRPLKTCSRPIRIGLSRKARIKQLHPYLKQMCYGNLKENF

SEQ ID NO: 15421 - protein, 560 aa, Homo sapiens
MTVKPAKAASLARNLAKRRRTYLGGAAGRSQEPEVPCAAVLPGKPGDRNCPEFPPPDRTLGCWATDAAPAAGLCGAGSEPSIAPTSCAGNLPSRPPPLLSPLLASRNPCPWHYLHLSGSHNTLAPTCFKAKLHRKRGSQPPDMASALTDRTSRAPSTYTYTSRPRALPCQRSRYRDSLTQPDEEPMHYGNIMYDRRVIRGNTYALQTGPLLGRPDSLELQRQREARKRALARKQAQEQLRPQTPEPVEGRKHVDVQTELYLEEIADRIIEVDMECQTDAFLDRPPTPLFIPAKTGKDVATQILEGELFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 15422 - protein, 464 aa, Homo sapiens
MTVKPAKAASLARNLAKRRRTYLGGAAGRSQEPEVPCAAVLPGKPGDRNCPEFPPPDRTLGCWATDAAPAAGLCGAGSEPSIAPTSCAGNLPSRPPPLLSPLLASRNPCPWHYLHLSGSHNTLAPTCFKAKLHRKRGSQPPDMASALTDRTSRAPSTYTYTSRPRALPCQRSRYRDSLTQPDEEPMHYGNIMYDRRVIRGNTYALQTGPLLFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 15423 - protein, 418 aa, Homo sapiens
MASALTDRTSRAPSTYTYTSRPRALPCQRSRYRDSLTQPDEEPMHYGNIMYDRRVIRGNTYALQTGPLLGRPDSLELQRQREARKRALARKQAQEQLRPQTPEPVEGRKHVDVQTELYLEEIADRIIEVDMECQTDAFLDRPPTPLFIPAKTGKDVATQILEGELFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 15424 - protein, 322 aa, Homo sapiens
MASALTDRTSRAPSTYTYTSRPRALPCQRSRYRDSLTQPDEEPMHYGNIMYDRRVIRGNTYALQTGPLLFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 15425 - protein, 870 aa, Homo sapiens
MVKEKKKADKKGEKSARSPSSLSDNLDFSKQDGNTTRQEMSPAGVPLLGMQLNEVKPKKDRQNVQQNEDATQYEESILTKLIVESYEGEKVRGLYEGEGFAAFQGGCTYRGMFSEGLMHGQGTYIWADGLKYEGDFVKNVPMNHGVYTWPDGSMYEGEVVNGMRNGFGMFKCSTQPVSYIGHWCNGKRHGKGSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQKRSPSLFLCFTKLMTENIRPNAFQIKGNLFREQQRTLYSMSYMNKCWEIYLAYCRPSAAPPHEPTMKMRHFLWMLKDFKMINKELTAATFMEVIAEDNRFIYDGIDSNFEPELVFLEFFEALLSFAFICVTDQMTKSYTNVPADDVSGNKHETIYTILNQDAQNKSPSAVMSHESDAAHSDSARSSSSKLELSPDVNKIRKSEPKIKKSVSHERVSKMNFKLTGKGITFFSSESKKYERPKDDREEEFNTWVNNMYVFFVNTLFHAYKREEAIKEKIRADRLRSTAQAQQRKMEDDELEARLNIFILREEEAKRHDYEVDITVLKEPADVSSSHLILDPPKEDVTVSPSSKTITSKKKKK

SEQ ID NO: 15426 - protein, 618 aa, Homo sapiens
MNHGVYTWPDGSMYEGEVVNGMRNGFGMFKCSTQPVSYIGHWCNGKRHGKGSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQKRSPSLFLCFTKLMTENIRPNAFQIKGNLFREQQRTLYSMSYMNKCWEIYLAYCRPSAAPPHEPTMKMRHFLWMLKDFKMINKELTAATFMEVIAEDNRFIYDGIDSNFEPELVFLEFFEALLSFAFICVTDQMTKSYTNVPADDVSGNKHETIYTILNQDAQNKSPSAVMSHESDAAHSDSARSSSSKLELSPDVNKIRKSEPKIKKSVSHERVSKMNFKLTGKGITFFSSESKKYERPKDDREEDGR

SEQ ID NO: 15427 - protein, 870 aa, Homo sapiens; identical to SEQ ID NO: 15425

SEQ ID NO: 15428 - protein, 870 aa, Homo sapiens; identical to SEQ ID NO: 15425

SEQ ID NO: 15429 - protein, 870 aa, Homo sapiens; identical to SEQ ID NO: 15425

SEQ ID NO: 15430 - protein, 4 aa, Homo sapiens
MVKE

SEQ ID NO: 15431 - protein, 280 aa, Homo sapiens
MRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQQFIP

SEQ ID NO: 15432 - protein, 13 aa, Homo sapiens
MVKEKKKADKKGE

SEQ ID NO: 15433 - protein, 870 aa, Homo sapiens
MVKEKKKADKKGEKSARSPSSLSDNLDFSKQDGNTTRQEMSPAGVPLLGMQLNEVKPKKDRQNVQQNEDASQYEESILTKLIVESYEGEKVRGLYEGEGFAAFQGGCTYRGMFSEGLMHGQGTYIWADGLKYEGDFVKNVPMNHGVYTWPDGSMYEGEVVNGMRNGFGMFKCSTQPVSYIGHWCNGKRHGKGSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQKRSPSLFLCFTKLMTENIRPNACQIKGNLFREQQRTLYSMSYMNKCWEIYLAYCRPSAAPPHEPTMKMRHFLWMLKDFKMINKELTAATFMEVIAEDNRFIYDGIDSNFEPELVFLEFFEALLSFAFICVTDQMTKSYTNVPADDVSGNKHETIYTILNQDAQNKSPSAVMSHESDAAHSDSARSSSSKLELSPDVNKIRKSEPKIKKSVSHERVSKMNFKLTGKGITFFSSESKKYERPKDDREEEFNTWVNNTYVFFVNTLFHAYKREEAIKEKIRADRLRSTAQAQQRKMEDDELEARLNIFILREEEAKRHDYEVDITVLKEPADVSSSHLILDPPKEDVTVSPSSKTITSKKKKK

SEQ ID NO: 15434 - protein, 280 aa, Homo sapiens; identical to SEQ ID NO: 15431

SEQ ID NO: 15435 - protein, 870 aa, Homo sapiens; identical to SEQ ID NO: 15433

SEQ ID NO: 15436 - protein, 870 aa, Homo sapiens; identical to SEQ ID NO: 15433

SEQ ID NO: 15437 - protein, 59 aa, Homo sapiens
MVKEKKKADKKGEKSARSPSSLSDNLDFSKQDGNTTRQEMSPAGVPLLGMQLNEVKPKK

SEQ ID NO: 15438 - protein, 870 aa, Homo sapiens; identical to SEQ ID NO: 15433

SEQ ID NO: 15439 - protein, 9 aa, Homo sapiens
MVKEKKKAD

SEQ ID NO: 15440 - protein, 618 aa, Homo sapiens
MNHGVYTWPDGSMYEGEVVNGMRNGFGMFKCSTQPVSYIGHWCNGKRHGKGSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQKRSPSLFLCFTKLMTENIRPNACQIKGNLFREQQRTLYSMSYMNKCWEIYLAYCRPSAAPPHEPTMKMRHFLWMLKDFKMINKELTAATFMEVIAEDNRFIYDGIDSNFEPELVFLEFFEALLSFAFICVTDQMTKSYTNVPADDVSGNKHETIYTILNQDAQNKSPSAVMSHESDAAHSDSARSSSSKLELSPDVNKIRKSEPKIKKSVSHERVSKMNFKLTGKGITFFSSESKKYERPKDDREEDGR

SEQ ID NO: 15441 - protein, 717 aa, Homo sapiens
MGDLPPYPERPAQQPPGRRTSQASQRRHSRDQAQALAADPEERQQIPPDAQRNAPGWSQRGSLSQQENLLMPQVFQAEEARLGGMEYPSVNTGFPSEFQPQPYSDESRMQVAELTTSLMLQRLQQGQSSLFQQLDPTFQEPPVNPLGQFNLYQTDQFSEGAQHGPYIRDDPALQFLPSELGFPHYSAQVPEPEPLELAVQNAKAYLLQTSINCDLSLYEHLVNLLTKILNQRPEDPLSVLESLNRTTQWEWFHPKLDTLRDDPEMQPTYKMAEKQKALFTRSGGGTEGEQEMEEEVGETPVPNIMETAFYFEQAGVGLSSDESFRIFLAMKQLVEQQPIHTCRFWGKILGIKRSYLVAEVEFREGEEEAEEEEVEEMTEGGEVMEAHGEEEGEEDEEKAVDIVPKSVWKPPPVIPKEESRSGANKYLYFVCNEPGLPWTRLPHVTPAQIVNARKIKKFFTGYLDTPVVSYPPFPGNEANYLRAQIARISAATQVSPLGFYQFSEEEGDEEEEGGAGRDSYEENPDFEGIPVLELVDSMANWVHHTQHILPQGRCTWVNPLQKTEEEEDLGEEEEKADEGPEEVEQEVGPPLLTPLSEDAEIMHLAPWTTRLSCSLCPQYSVAVVRSNLWPGAYAYASGKKFENIYIGWGHKYSPESFNPALPAPIQQEYPSGPEIMEMSDPTVEEEQALKAAQEQALGATEEEEEGEEEEEGEETDD

SEQ ID NO: 15442 - protein, 1494 aa, Homo sapiens
MYSEWRSLHLVIQNDQGHTSVLHSYPESVGREVANAVVRPLGQVLGTPSVAGSENLLKTDKEVKWTMEVICYGLTLPLDGETVKYCVDVYTDWIMALVLPKDSIPLPVIKEPNQYVQTILKHLQNLFVPRQEQGSSQIRLCLQVLRAIQKLARESSLMARETWEVLLLFLLQINDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 15443 - protein, 963 aa, Homo sapiens
MYSEWRSLHLVIQNDQGHTSVLHSYPESVGREVANAVVRPLGQVLGTPSVAGSENLLKTDKEVKWTMEVICYGLTLPLDGETVKYCVDVYTDWIMALVLPKDSIPLPVIKEPNQYVQTILKHLQNLFVPRQEQGSSQIRLCLQVLRAIQKLARESSLMARETWEVLLLFLLQINDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKQLEPEFYTSLFQEVGLKNCSS

SEQ ID NO: 15444 - protein, 1273 aa, Homo sapiens
MVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 15445 - protein, 1494 aa, Homo sapiens; identical to SEQ ID NO: 15442

SEQ ID NO: 15446 - protein, 1491 aa, Homo sapiens
MYSEWRSLHLVIQNDQGHTSVLHSYPESVGREVANAVVRPLGQVLGTPSVAGSENLLKTDKEVKWTMEVICYGLTLPLDGETVKYCVDVYTDWIMALVLPKDSIPLPVIKEPNQYVQTILKHLQNLFVPRQEQGSSQIRLCLQVLRAIQKLARESSLMARETWEVLLLFLLQINDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 15447 - protein, 1323 aa, Homo sapiens
INDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 15448 - protein, 477 aa, Homo sapiens [sequence omitted]

SEQ ID NO: 15449 - protein, 777 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 15450 - protein, 146 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALES

SEQ ID NO: 15451 - protein, 777 aa, Homo sapiens; identical to SEQ ID NO: 15449

SEQ ID NO: 15452 - protein, 777 aa, Homo sapiens; identical to SEQ ID NO: 15449

SEQ ID NO: 15453 - protein, 658 aa, Homo sapiens
MADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRGEGPLLLHLASPVARLPQELLRVREEGAPFPGSRPQGGRLHGHCSEEEAPLAYRSHGVHTRCG

SEQ ID NO: 15454 - protein, 146 aa, Homo sapiens; identical to SEQ ID NO: 15450

SEQ ID NO: 15455 - protein, 146 aa, Homo sapiens; identical to SEQ ID NO: 15450

SEQ ID NO: 15456 - protein, 460 aa, Homo sapiens [sequence omitted]

SEQ ID NO: 15457 - protein, 146 aa, Homo sapiens; identical to SEQ ID NO: 15450

SEQ ID NO: 15458 - protein, 777 aa, Homo sapiens; identical to SEQ ID NO: 15449

SEQ ID NO: 15459 - protein, 146 aa, Homo sapiens; identical to SEQ ID NO: 15450

SEQ ID NO: 15460 - protein, 777 aa, Homo sapiens; identical to SEQ ID NO: 15449

SEQ ID NO: 15461 - protein, 460 aa, Homo sapiens [sequence omitted]

SEQ ID NO: 15462 - protein, 658 aa, Homo sapiens; identical to SEQ ID NO: 15453

SEQ ID NO: 15463 - protein, 658 aa, Homo sapiens; identical to SEQ ID NO: 15453

SEQ ID NO: 15464 - protein, 658 aa, Homo sapiens; identical to SEQ ID NO: 15453

SEQ ID NO: 15465 - protein, 658 aa, Homo sapiens; identical to SEQ ID NO: 15453

SEQ ID NO: 15466 - protein, 460 aa, Homo sapiens [sequence omitted]

SEQ ID NO: 15467 - protein, 460 aa, Homo sapiens [sequence omitted]

SEQ ID NO: 15468 - protein, 460 aa, Homo sapiens [sequence omitted]

SEQ ID NO: 15469 - protein, 497 aa, Homo sapiens
ARAGRGAASGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRGWEEMLISAIKSVGTFFGMFAMCQARFYR

SEQ ID NO: 15470 - protein, 710 aa, Homo sapiens
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDPPAHSDLGSVRTFLGWAAPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 15471 - protein, 716 aa, Homo sapiens
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDPPAHSDLGSVRTFLGWAAPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSLCISPSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 15472 - protein, 270 aa, Homo sapiens
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRLFRGLRGGRGRAHASRSPAPGLQRGRGGRAADPHRLGALLQGEALRVLGLRVVAEGPAGGCRRLPHCARHRGPVQHRDRLCAGFRARSTGLGRPAEGAAAGEVDPHRPALPRTAELLLLARHPVRPAI

SEQ ID NO: 15473 - protein, 85 aa, Homo sapiens
MTGKTQTSNVTNKNDPKSINSRVFIGNLNTAIVKKVDIEAIFSKYGKIVGCSVHKGYAFVQYMSERHARAAVAGENARVIAGQPL

SEQ ID NO: 15474 - protein, 291 aa, Homo sapiens
MTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 15475 - protein, 291 aa, Homo sapiens; identical to SEQ ID NO: 15474

SEQ ID NO: 15476 - protein, 291 aa, Homo sapiens; identical to SEQ ID NO: 15474

SEQ ID NO: 15477 - protein, 85 aa, Homo sapiens; identical to SEQ ID NO: 15473

SEQ ID NO: 15478 - protein, 218 aa, Homo sapiens
MTMYKSKRRHQRYINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 15479 - protein, 661 aa, Homo sapiens
MKPLEKFLKKQTSQLAGRTVAGGPGGGLGSCGGPGGGGGPGGGGGPAGGQRSLQRRQSVSRLLLPAFLREPPAEPGLEPPPEEGGEPAGVAEEPGSGGPCWLQLEEVPGPGPLGGGGPLRSPSSYSSDELSPGEPLTSPPWAPLGAPERPEHLLNRVLERLAGGATRDSAASDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 15480 - protein, 456 aa, Homo sapiens
MEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 15481 - protein, 456 aa, Homo sapiens; identical to SEQ ID NO: 15480

SEQ ID NO: 15482 - protein, 20 aa, Homo sapiens
MEGPEGLGRKQACLAMLLHF

SEQ ID NO: 15483 - protein, 101 aa, Homo sapiens
MEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTR

SEQ ID NO: 15484 - protein, 149 aa, Homo sapiens
MEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEP

SEQ ID NO: 15485 - protein, 452 aa, Homo sapiens
MPDLPHLLAFLSASRDVLPRTLLLPPPTLGPRDEHTDPVQIGRVQQDTPGKVLSIVNQLYLETHRGWGREQTPQETEPEAAQRHDPAPRNPAPHGVSWVKGPLSPEVDHPGPALASLLEEEEEDLEGKEEGREDDPEEEGPEDVLTIHVQSLVRARSSYVARQYRSLRVRIASDSGGPHGSGDPATELLQDVRHLLTDLQDHLAKDSYIRAVFGSRGPGLPKKDEDPGPALETAVCQAVLAPLKPALWTRLRTLRAPELRRLRRRQTALRAGAGPPGAQGPGPEGQSPAPALRSRIHERLAHLHAACAPRRKVALLLEVCRDVYAGLARGENQDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQANLPFKEPWAEETVTGTSDN

SEQ ID NO: 15486 - protein, 452 aa, Homo sapiens; identical to SEQ ID NO: 15485

SEQ ID NO: 15487 - protein, 419 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVRLEQKIKRNDVEIEEEEFWENELQIEQENEKQLKDQLQEIRQKITECENKLKDYLAQIRTMESGLEAEKLQREVQEAQVNEEEVKGKIGKVKGEIDIQGQQSLRLENGIKAVERSLGQATKRLQDKEQELEQLTKELRQVNLQQFIQQTGTKVTVLPAEPIEIEASHADIEREAPFQSGSLKRPGSSRQLPSNLRILQNPISSGFNPEGIYV

SEQ ID NO: 15488 - protein, 392 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVRLEQKIKRNDVEIEEEEFWENELQIEQENEKQLKDQLQEIRQKITECENKLKDYLAQIRTMESGLEAEKLQREVQEAQVNEEEVKGKIGKVKGEIDIQGQQSLRLENGIKAVERSLGQATKRLQDKEQELEQLTKELRQVNLQQFIQQTGTKVTVLPAEPIEIEASHADIERGIIILSDKQECKD

SEQ ID NO: 15489 - protein, 419 aa, Homo sapiens; identical to SEQ ID NO: 15487

SEQ ID NO: 15490 - protein, 91 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSD

SEQ ID NO: 15491 - protein, 29 aa, Homo sapiens
MELKVWVDGVQRIVCGVTEVTTCQEVVIA

SEQ ID NO: 15492 - protein, 208 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVR

SEQ ID NO: 15493 - protein, 419 aa, Homo sapiens; identical to SEQ ID NO: 15487

SEQ ID NO: 15494 - protein, 109 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPLS

SEQ ID NO: 15495 - protein, 219 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVRLEQKIKRNDVE

SEQ ID NO: 15496 - protein, 122 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKR

SEQ ID NO: 15497 - protein, 419 aa, Homo sapiens; identical to SEQ ID NO: 15487

SEQ ID NO: 15498 - protein, 159 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNC

SEQ ID NO: 15499 - protein, 803 aa, Homo sapiens
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSVESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVHQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 15500 - protein, 757 aa, Homo sapiens
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSVESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVHQGVAQLKDFITKLVDIEEKDELDLQRTLSLQAPPVKEGPLFIHRTKGKGPLMSSSFKKLYFSLTTEALSFAKTPSSKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 15501 - protein, 1257 aa, Homo sapiens
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKSDASLYCDDVDIRFSKTMNSCKVLQIRYASVERLLERLTDLRFLSIDFLNTFLHSYRVFTTAIVVLDKLITIYKKPISAIPARSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 15502 - protein, 489 aa, Homo sapiens
MYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 15503 - protein, 1273 aa, Homo sapiens
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKRTREGTREAEMSRSDASLYCDDVDIRFSKTMNSCKVLQIRYASVERLLERLTDLRFLSIDFLNTFLHSYRVFTTAIVVLDKLITIYKKPISAIPARWLRSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 15504 - protein, 1260 aa, Homo sapiens
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKSDASLYCDDVDIRFSKTMNSCKVLQIRYASVERLLERLTDLRFLSIDFLNTFLHSYRVFTTAIVVLDKLITIYKKPISAIPARWLRSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 15505 - protein, 489 aa, Homo sapiens
MFLEPQETMPQTSVVFSSILGPSCSGQVQPGMGERGGGAGGGSGDLIFQDGHLISGSLEALMEHLVPTVDYYPDRTYIFTFLLSSRVFMPPHDLLARVGQICVEQKQQLEAGPEKAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRCRGDLTKTYSLEAYDNWFNCLSMLVATEVCRVVKKKHRTRMLEFFIDVARECFNIGNFNSMMAIISGMNLSPVARLKKTWSKVKTAKFDVLEHHMDPSSNFCNYRTALQGATQRSQMANSSREKIVIPVFNLFVKDIYFLHKIHTNHLPNGHINFKKFWEISRQIHEFMTWTQVECPFEKDKKIQSYLLTAPIYSEEALFVASFESEGPENHMEKDSWKTLRTTLLNRA

SEQ ID NO: 15506 - protein, 481 aa, Homo sapiens
MPQTSVVFSSILGPSCSGQVQPGMGERGGGAGGGSGDLIFQDGHLISGSLEALMEHLVPTVDYYPDRTYIFTFLLSSRVFMPPHDLLARVGQICVEQKQQLEAGPEKAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRCRGDLTKTYSLEAYDNWFNCLSMLVATEVCRVVKKKHRTRMLEFFIDVARECFNIGNFNSMMAIISGMNLSPVARLKKTWSKVKTAKFDVLEHHMDPSSNFCNYRTALQGATQRSQMANSSREKIVIPVFNLFVKDIYFLHKIHTNHLPNGHINFKKFWEISRQIHEFMTWTQVECPFEKDKKIQSYLLTAPIYSEEALFVASFESEGPENHMEKDSWKTLRTTLLNRA

SEQ ID NO: 15507 - protein, 481 aa, Homo sapiens; identical to SEQ ID NO: 15506

SEQ ID NO: 15508 - protein, 473 aa, Homo sapiens
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEQTYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 15509 - protein, 431 aa, Homo sapiens
MPQTPPFSAMFDSSGYNRNLYQSAEDSCGGLYYHDNNLLSGSLEALIQHLVPNVDYYPDNQMRKIAPKILQLLTEWTETFPYDFRDERMMRNLKDLAHRIASGEETYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 15510 - protein, 210 aa, Homo sapiens
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEVGNLNLARLLEFPGRAWVGNGAELCILISTASSLFCLWASPPHHILVYLVCQVRMIIPSHFKGI

SEQ ID NO: 15511 - protein, 210 aa, Homo sapiens; identical to SEQ ID NO: 15510

SEQ ID NO: 15512 - protein, 472 aa, Homo sapiens
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEETYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 15513 - protein, 466 aa, Homo sapiens
MPQTLSASDMVTPGSLSPPPTEPTDGEQAGQPLLDGAPSSASLETLIQHLVPTADYYPEKAYIFTFLLSSRLFIEPRELLARVCHLCIEQQQLDKPVLDKARVRKFGPKLLQLLAEWTETFPRDFQEESTIGHLKDVVGRIAPCDEAYRKRMHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWFNRLCYLVATEICMPAKKKQRAQVIEFFIDVARECFNIGNFNSLMAIISGMNMSPVSRLKKTWAKVRTAKFFILEHQMDPTGNFCNYRTALRGAAHRSLTAHSSREKIVIPFFSLLIKDIYFLNEGCANRLPNGHVNFEKFLELAKQVGEFITWKQVECPFEQDASITHYLYTAPIFSEDGLYLASYESESPENQTEKERWKALRSSILGKT

SEQ ID NO: 15514 - protein, 466 aa, Homo sapiens; identical to SEQ ID NO: 15513

SEQ ID NO: 15515 - protein, 266 aa, Homo sapiens
MSSVFGKPRAGSGPQSAPLEVNLAILGRRGAGKSALTVKFLTKRFISEYDPNLEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 15516 - protein, 247 aa, Homo sapiens
MSSVFGKPRAGSGPQSAPLEVNLAILGRRGAGKSEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 15517 - protein, 255 aa, Homo sapiens
MVIMGPELVGSWSDFKNEAADPRALTVKFLTKRFISEYDPNLEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 15518 - protein, 376 aa, Homo sapiens
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 15519 - protein, 376 aa, Homo sapiens; identical to SEQ ID NO: 15518

SEQ ID NO: 15520 - protein, 197 aa, Homo sapiens
MEERPAETNANVDNSASPSVAQLAGRFREQAAAAKETPASKPTRRKPPCSLPLFPPKVDLGQNGEEANLTFDPAALLPGASPKSPGLKAMVSPFHSPPSTPSSPGVRSRPSEAEEVPVSFDQPPEGSHLPCYNKVRTRGSIKRRPPSRRFRRSQSDCGELGDFRAVESSQQNGAKEEDGDEVLPSKSKAPGSPLSSE

SEQ ID NO: 15521 - protein, 416 aa, Homo sapiens
MEERPAETNANVDNSASPSVAQLAGRFREQAAAAKETPASKPTRRKPPCSLPLFPPKVDLGQNGEEKSPPNASHPPKFKVKSSPLIEKLQANLTFDPAALLPGASPKSPGLKAMVSPFHSPPSTPSSPGVRSRPSEAEEVPVSFDQPPEGSHLPCYNKVRTRGSIKRRPPSRRFRRSQSDCGELGDFRAVESSQQNGAKEEDGDEVLPSKSKAPGSPLSSEGAAGEGVRTLGPAEKPPLRRSPSRTEKQEEDRATEEAKNGEKARRSSEEVDGQHPAQEEVPESPQTSGPEAENRCGSPREEKPAGEEAEMEKATEVKGERVQNEEVGPEHDSQETKKLEEGAAVKETPHSPPGGVKGGDVPKQEKGKEKQQEGAVLEPGCSPQTGPAQLETSSEVQSEPAVPKPEDDTPVQDTKM

SEQ ID NO: 15522 - protein, 386 aa, Homo sapiens
MEERPAETNANVDNSASPSVAQLAGRFREQAAAAKEKSPPNASHPPKFKVKSSPLIEKLQANLTFDPAALLPGASPKSPGLKAMVSPFHSPPSTPSSPGVRSRPSEAEEVPVSFDQPPEGSHLPCYNKVRTRGSIKRRPPSRRFRRSQSDCGELGDFRAVESSQQNGAKEEDGDEVLPSKSKAPGSPLSSEGAAGEGVRTLGPAEKPPLRRSPSRTEKQEEDRATEEAKNGEKARRSSEEVDGQHPAQEEVPESPQTSGPEAENRCGSPREEKPAGEEAEMEKATEVKGERVQNEEVGPEHDSQETKKLEEGAAVKETPHSPPGGVKGGDVPKQEKGKEKQQEGAVLEPGCSPQTGPAQLETSSEVQSEPAVPKPEDDTPVQDTKM

SEQ ID NO: 15523 - protein, 200 aa, Homo sapiens
MGNSKSGALSKEILEELQLNTKFSEEELCSWYQSFLKDCPTGRITQQQFQSIYAKFFPDTDPKAYAQHVFRSFDSNLDGTLDFKEYVIALHMTTAGKTNQKLEWAFSLYDVDGNGTISKNEVLEIVMAIFKMITPEDVKLLPDDENTPEKRAEKIWKYFGKNDDDKLTEKEFIEGTLANKEILRLIQFEPQKVKEKMKNA

SEQ ID NO: 15524 - protein, 289 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEILDMGVSSNDVVTISIFFLLKINIKP

SEQ ID NO: 15525 - protein, 276 aa, Homo sapiens
MRNSNWRFCQTGIYSKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 15526 - protein, 312 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 15527 - protein, 312 aa, Homo sapiens; identical to SEQ ID NO: 15526

SEQ ID NO: 15528 - protein, 326 aa, Homo sapiens
MSSFSESALEKKLSELSNSQQSVQTLSLWLIHHRKHAGPIVSVWHRELRKAKSNRKLTFLYLANDVIQNSKRKGPEFTREFESVLVDAFSHVAREADEGCKKPLERLLNIWQERSVYGGEFIQQLKLSMEDSKSPPPKATEEKKSLKRTFQQIQEEEDDDYPGSYSPQDPSAGPLLTEELIKALQDLENAASGDATVRQKIASLPQEVQDVSLLEKITDKEAAERLSKTVDEACLLLAEYNGRLAAELEDRRQLARMLVEYTQNQKDVLSEKEKKLEEYKQKLARVTQVRKELKSHIQSLPDLSLLPNVTGGLAPLPSAGDLFSTD

SEQ ID NO: 15529 - protein, 152 aa, Homo sapiens
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSKCLFLS

SEQ ID NO: 15530 - protein, 1461 aa, Homo sapiens
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSTTFKTQKQLKENLNKQPNKQWKKSQTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTMESEKSATPEPVTDNRDVEDMELSDVEDDGSKIIVEDRKEKPAEKSAVSTSVPTKPTENISKASSCTPVPVTMTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGGSNSSSGPPLGPSHRDTISRSGIILRSPRPDFRPREPFLSRDPFHSLKRPRPPFARGPPFFAPKRPFFPPRY

SEQ ID NO: 15531 - protein, 1435 aa, Homo sapiens
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTMESEKSATPEPVTDNRDVEDMELSDVEDDGSKIIVEDRKEKPAEKSAVSTSVPTKPTENISKASSCTPVPVTMTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGGSNSSSGPPLGPSHRDTISRSGIILRSPRPDFRPREPFLSRDPFHSLKRPRPPFARGPPFFAPKRPFFPPRY

SEQ ID NO: 15532 - protein, 934 aa, Homo sapiens
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTMESEKSATPEPVTDNRDVEDMELSDVEDDGSKIIVEDRKEKPAEKSAVSTSVPTKPTENISKASSCTPVPVTMTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPKHPCRSHGSPTHVRRGESPGLHHFHHVDD

SEQ ID NO: 15533 - protein, 1076 aa, Homo sapiens
MSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGGEELVDFWILAENILSIDEMDLEVRDYYLSLLLMLRATHLQEGSRVVTLCNMNIKSLLNLSIWHPNQSTTRREILSHMQKVALFKLQSYWLPNFYTHTKMTMAKEEACHGLMQEYETRLYSVCYTHIGGLPLNMSIKKCHHFQKRYSSRKAKRKMWQLVDPDSWSLEMDLKPDAIGMPLQETCPQEKVVIQMPSLKMASSKETRISSLEKDMHYAKISSMENKAKSHLHMEAPFETKVSTHLRTVIPIVNHSSKMTIQKAIKQSFSLGYIHLALCADACAGNPFRDHLKKLNLKVEIQLLDLWQDLQHFLSVLLNNKKNGNAIFRHLLGDRICELYLNEQIGPCLPLKSQTIQGLKELLPSGDVIPWIPKAQKEICKMLSPWYDEFLDEEDYWFLLFTTQNRFISSRQHKREFIGKEENILLYKRIQQSLELSQALADMKEMDYRQWRKIATEDLKQGGSLQVELTSPVFLTDITKMSFEELCYKNPKMAIQKISDDYKIYCEKAPKIDFKMEIIKETKTVSRSNRKMSLLKRTLVRKPSMRPRNLTEVLLNTQHLEFFREFLKERKAKIPLQFLTAVQKISIETNEKICKSLIENVIKTFFQGQLSPEEMLQCDAPIIKEIASMRHVTTSTLLTLQGHVMKSIEEKWFKDYQDLFPPHHQEVEVQSEVQISSRKPSKIVSTYLQESQKKGWMRMISFIRSFCKYRRFMLNPSKRQEFEDYLHQEMQNSKENFTTAHNTSGRSAPPSTNVRSADQENGEITLVKRRIFGHRIITVNFAINDLYFFSEMEKFNDLVSSAHMLQVNRAYNENDVILMRSKMNIIQKLFLNSDIPPKLRVNVPEFQKDAILAAITEGYLDRSVFHGAIMSVFPVVMYFWKRFCFWKATRSYLQYRGKKFKDRKSPPKSTDKYPFSSGGDNAILRFTLLRGIEWLQPQREAISSVQNSSSSKLTQPRLVVSAMQLHPVQGQKLSYIKKEK

SEQ ID NO: 15534 - protein, 102 aa, Homo sapiens
MLSVRRVSEDICSRIYESAQRIDSITFLPSSGFHLKWKIQTRIANEKYLRTHKEVEWLISGFFREIFLKRPDNILEFAADYFTDPRLPNKIHMQLIKDKKAA

SEQ ID NO: 15535 - protein, 391 aa, Homo sapiens
MDQCVTVERELEKVLHKFSGYGQLCERGLEELIDYTGGLKHEILQSHGQDAELSGTLSLVLTQCCKRIKDTVQKLASDHKDIHSSVSRVGKAIDKNFDSDISSVGIDGCWQADSQRLLNEVMVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCPMEQSPGDAKQIFF

SEQ ID NO: 15536 - protein, 393 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 15537 - protein, 114 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDARE

SEQ ID NO: 15538 - protein, 148 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNV

SEQ ID NO: 15539 - protein, 57 aa, Homo sapiens
MEQCACVERELDKVLQKFLTYGQHCERSLEELLHYVGQLRAELASAALQGTPLSATL

SEQ ID NO: 15540 - protein, 393 aa, Homo sapiens; identical to SEQ ID NO: 15536

SEQ ID NO: 15541 - protein, 380 aa, Homo sapiens
MADCSLDLPGSSSPPSHLSLLRSWDHRRVPPCPALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 15542 - protein, 205 aa, Homo sapiens
MSNFLHLKYNEKSVSVTKALTVRFLTKRFIGEYASNFESIYKKHLCLERKQLNLEIYDPCSQTQKAKFSLTSELHWADGFVIVYDISDRSSFAFAKALIYRIREPQTSHCKRAVESAVFLVGNKRDLCHVREVGWEEGQKLALENRCQFCELSAAEQSLEVEMMFIRIIKDILINFKLKEKRRPSGSKSMAKLINNVFGKRRKSV

SEQ ID NO: 15543 - protein, 287 aa, Homo sapiens
MAEHFKQIIRCPVCLKDLEEAVQLKCGYACCLQCLNSLQKEPDGEGLLCRFCSVVSQKDDIKPKYKLRALVSIIKELEPKLKSVLTMNPRMRKFQVDMTFDVDTANNYLIISEDLRSFRSGDLSQNRKEQAERFDTALCVLGTPRFTSGRHYWEVDVGTSQVWDVGVCKESVNRQGKIVLSSEHGFLTVGCREGKVFAASTVPMTPLWVSPQLHRVGIFLDVGMRSIAFYNVSDGCHIYTFIEIPVCEPWRPFFAHKRGSQDDQSILSICSVINPSAASAPVSSEGK

SEQ ID NO: 15544 - protein, 263 aa, Homo sapiens
MAKRLQAELSCPVCLDFFSCSISLSCTHVFCFDCIQRYILENHDFRAMCPLCRDVVKVPALEEWQVSVLTLMTKQHNSRLEQSLHVREELRHFREDVTLDAATASSLLVFSNDLRSAQCKKIHHDLTKDPRLACVLGTPCFSSGQHYWEVEVGEVKSWSLGVCKEPADRKSNDLFPEHGFWISMKAGAIHANTHLERIPASPRLRRVGIFLDADLEEIQFFDVDNNVLIYTHDGFFSLELLCPFFCLELLGEGESGNVLTICP

SEQ ID NO: 15545 - protein, 198 aa, Homo sapiens
MPLFGWMKWPKNDSYKPTHYPGSDIVTKTLLRELKWHLKERERLIQEIENEQKVKKTGVDYNWLRNYQNPHTTIPVTEQRQLEVLCSQVQPCQTGTILSRFREVLAENDVLPWEIVYIFKQVLKDFLSSSDRGSEQEDLEDSGSMDCSAPSVIQGDSSKRADKDEIPTISSYVDKNTKDRFPVFSHRIWNLPYYHPSS

SEQ ID NO: 15546 - protein, 1388 aa, Homo sapiens
MSIPLHSLRFNNTMREENVEPQNKQMAFCRPMTETRADVQILHSHVQLPIVSTSASDPGGTSTQLMTSPVFDTMSAPLMGVPNSGALSPPLMPASDSGALSPLLMPASDSGALSPLLMPALDSGTLSPLLSTSEYGVMSPGMMTIPDFGTMSATLMVAPDSAEISPLAMPAPSSGVVCTPIMSTSSSEAMSTPLMLAPDSGELSPILMQDMNPGVMSTQPVPAPSSEAMSPLQITDEDTEAMSKVLMTALASGEISSLLMSGTDSEAISSLIMSAVASGGTSPQPTSTQNSGGIPTPLMSDLDSGIMSSLLMSSPGSEVMSTPLLSVPDAGEMSTLPKPAPDAEAMSPALMTALPSGVMPTQTMPAPGSGAMSPWSTQNVDSEMMSNPPVRATASGVMSAPPVRALDSGAMSTPLMGAPASGNMSTLQKTVPASGAMTTSLMTVPSSGVMSTEQMSATASRVMSAQLTMAKTSGAMPTGSMKAVAKQYKRATASGKMSTPLRRAPTSGAMSTQPVTATASETMSMPQLTVPASGSMSMLQMRAPVSEAMSMPQMRTMASGLTSAAQMKAMTSGAMSTPLMTAQTSGSTSTLLMRDTASGVMSCPQMRSLASGALSKPLMTPKASGTMFTEKMTTTASEAMPTLLMRDTVSGALSMPQMTDTASGGLSASLMRDTASGAMSTSQMTATVSGGMSMPLMRAQDPGVMPASLMRAKVSGKMLSQPMSTQDPGGMSMSPMKSMTAGGMQMNSPTSDVMSTPTVRAWTSETMSTPLMRTSDPGERPSLLTRASSSGEMSLPLMRAPASGEIATPLRSPAYGAMSAPQMTATASGMMSSMPQVKAPISGAMSMPLTRSTASGGMSMPLMRAPDSRVTSTSQMMPTASGDMCTLPVRAPASGGVSSPLVRAPASGTMSTPLRRPSACETVSTELMRASASGHMSTAQTTAMVSGGMSKPLMRAPASGTMPMPLMSAMASGEMSMPLMETMASGATSTLQTSVANSRSMSLSQTTYTVSGRMATAPIRASASGARSTSFMRASVSGSMPMPLPRATASGCGMGMSMPQMTATDSRGMSTPLMRASGPGTMSTPQTAFGVMSTPEIKATDSGEASTSHINITASGSKPTSHMTATTPETAKPPPKEVPSFGMLTPALCYLLEEQEAARGSCSVEEEMEIDEEKQMKGFLDDSERMAFLVSLHLGAAERWFILQMEVGEPLSHENKSFLRRSQGIYDSLSEIDILSAVLCHPKQGQKSVRQYATDFLLLARHLSWSDAILRTRFLEGLSEAVTTKMGRIFLKVAGSLKELIDRSLYTECQLAEEKDSPGNSSQVLPTACKRNNEEAMGNELSSQQQTEEHQHVSKRCYYLKEHGDPQEGLHDHLGQSTGHHQKAHTNK

SEQ ID NO: 15547 - protein, 88 aa, Homo sapiens
MSIPLHSLRFNNTMREENVEPQNKQMAFCRPMTETRADVQILHSHVQLPIVSTSASDPGGTSTQLMTSPVFDTMSAPLMGVPNSGALS

SEQ ID NO: 15548 - protein, 1388 aa, Homo sapiens; identical to SEQ ID NO: 15546

SEQ ID NO: 15549 - protein, 949 aa, Homo sapiens
MSIPLHSLRFNNTMREENVEPQNKQMAFCRPMTETRADVQILHSHVQLPIVSTSASDPGGTSTQLMTSPVFDTMSAPLMGVPNSGALSPPLMPASDSGALSPLLMPASDSGALSPLLMPALDSGTLSPLLSTSEYGVMSPGMMTIPDFGTMSATLMVAPDSAEISPLAMPAPSSGVVCTPIMSTSSSEAMSTPLMLAPDSGELSPILMQDMNPGVMSTQPVPAPSSEAMSPLQITDEDTEAMSKVLMTALASGEISSLLMSGTDSEAISSLIMSAVASGGTSPQPTSTQNSGGIPTPLMSDLDSGIMSSLLMSSPGSEVMSTPLLSVPDAGEMSTLPKPAPDAEAMSPALMTALPSGVMPTQTMPAPGSGAMSPWSTQNVDSEMMSNPPVRATASGVMSAPPVRALDSGAMSTPLMGAPASGNMSTLQKTVPASGAMTTSLMTVPSSGVMSTEQMSATASRVMSAQLTMAKTSGAMPTGSMKAVAKQYKRATASGKMSTPLRRAPTSGAMSTQPVTATASETMSMPQLTVPASGSMSMLQMRAPVSEATSTLQTSVANSRSMSLSQTTYTVSGRMATAPIRASASGARSTSFMRASVSGSMPMPLPRATASGCGMGMSMPQMTATDSRGMSTPLMRASGPGTMSTPQTAFGVMSTPEIKATDSGEASTSHINITASGSKPTSHMTATTPETAKPPPKEVPSFGMLTPALCYLLEEQEAARGSCSVEEEMEIDEEKQMKGFLDDSERMAFLVSLHLGAAERWFILQMEVGEPLSHENKSFLRRSQGIYDSLSEIDILSAVLCHPKQGQKSVRQYATDFLLLARHLSWSDAILRTRFLEGLSEAVTTKMGRIFLKVAGSLKELIDRSLYTECQLAEEKDSPGNSSQVLPTACKRNNEEAMGNELSSQQQTEEHQHVSKRCYYLKEHGDPQEGLHDHLGQSTGHHQKAHTNK

SEQ ID NO: 15550 - protein, 569 aa, Homo sapiens
MSEASGNLNSLRMANVALREELNALRGENANLGLQLGRALAEVNSLRGNVSSYIRWPVPIVPVLAEENLEFALSEIEVIPGGELPFLCRPPPRAEPDCISDDLLINVIQDRSTPDGPADPPLLPIPPPPALPPPASKEPPPQPPLAPLERPEIEPFSGDPVYLAEFLMQLETFIADHEVHFPGGAERVAFLISFFTGEAKDWAISVTQEGSPLHANFPRFLDEIRKEFCGPIPPRVAKKAIRKLKQGHCTLGSYADAFQFLAQFLSWDDCRLQNQFLKGLSEFFRKELLWSTEMADLDELILECVEIERKVRVPKPIPLPGVRNIIFPFAPSPNEEESEDEEYYSEDEDQEARRHRLHSKDQRKRMRAFQQEMKEKEEEEMKKEEEMKKKEEKEEEEEEEMKQKEEEEEIRNKNEEEGESKDEEDEDEDGGQKPEGEPQQDPGTEETYGEVEEEPLDEAQDDDLDELMEMEPTFVHASSQTSGPTSGYHAENFLGASPPIIQPSRRRNQNRVPLLEGLPGTNSPFYSSPQLIRRTGRLGQRQVRRRPPVLFRLTPRQGGHRAARGRIRV

SEQ ID NO: 15551 - protein, 569 aa, Homo sapiens; identical to SEQ ID NO: 15550

SEQ ID NO: 15552 - protein, 675 aa, Homo sapiens
MLRATAPCWFPPGYPEAKKVAEEAALEASRHLGGEQSQAGAPEGSKMLRATAPCWFRPGYPEAKKVAKEAAPEASRHLGAEQSPAGAPEGSKMLRATAPCWFPPGYPEAKKVAEEAALEAPEFPLPSHQPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSRGSKVGRQPGKTRNRSGMACKTTATTSSKRIVRRASLPSLSLKKPIILRSSGCQVPTVLRRGYLQLFTEECLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSSGRCVRDQLCYYHWGRVRSSQVAGGRVSQYTCCAAAPGSVGCQVAKQHVRDGRKESLDGFVETFKKELSRDAYPGIYALDCEMCYTTHGLELTRVTVVDADMRVVYDTFVKPDNEIVDYNTRFSGVTEADVAKTSITLPQVQAILLSFFSAQTILIGHSLESDLLALKLIHSTVVDTAVLFPHYLGFPYKRSLRNLAADYLAQIIQDSQDGHNSSEDANACLQLVMWKVRQRAQIQPRHRSASPAALACP

SEQ ID NO: 15553 - protein, 675 aa, Homo sapiens; identical to SEQ ID NO: 15552

SEQ ID NO: 15554 - protein, 1287 aa, Homo sapiens
MVARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 15555 - protein, 246 aa, Homo sapiens
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMEVGLGRGLGDSEWVRGCVCHHAQHREILDGNRVASAVEDEGAEVDGEAFRWGSLWVGESWDM

SEQ ID NO: 15556 - protein, 1126 aa, Homo sapiens
MVARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 15557 - protein, 1123 aa, Homo sapiens
MLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 15558 - protein, 874 aa, Homo sapiens
MGLPTLEFSDSYLDSPDFRERLQCHEIELERTNKFIKELIKDGSLLIGALRNLSMAVQKFSQSLQDFQFECIGDAETDDEISIAQSLKEFARLLIAVEEERRRLIQNANDVLIAPLEKFRKEQIGAAKDGKKKFDKESEKYYSILEKHLNLSAKKKESHLQEADTQIDREHQNFYEASLEYVFKIQEVQEKKKFEFVEPLLSFLQGLFTFYHEGYELAQEFAPYKQQLQFNLQNTRNNFESTRQEVERLMQRMKSANQDYRPPSQWTMEGYLYVQEKRPLGFTWIKHYCTYDKGSKTFTMSVSEMKSSGKMNGLVTSSPEMFKLKSCIRRKTDSIDKRFCFDIEVVERHGIITLQAFSEANRKLWLEAMDGKEPIYTLPAIISKKEEMYLNEAGFNFVRKCIQAVETRGITILGLYRIGGVNSKVQKLMNTTFSPKSPPDIDIDIELWDNKTITSGLKNYLRCLAEPLMTYKLHKDFIIAVKSDDQNYRVEAVHALVHKLPEKNREMLDILIKHLVKVSLHSQQNLMTVSNLGVIFGPTLMRAQEETVAAMMNIKFQNIVVEILIEHYEKIFHTAPDPSIPLPQPQSRSGSRRTRAICLSTGSRKPRGRYTPCLAEPDSDSYSSSPDSTPMGSIESLSSHSSEQNSTTKSASCQPREKSGGIPWIATPSSSNGQKSLGLWTTSPESSSREDATKTDAESDCQSVASVTSPGDVSPPIDLVKKEPYGLSGLKRASASSLRSISAAEGNKSYSGSIQSLTSVGSKETPKASPNPDLPPKMCRRLRLDTASSNGYQRPGSVVAAKAQLFENVGSPKPVSSGRQAKAMYSCKAEHSHELSFPQGAIFSNVYPSVEPGWLKATYEGKTGLVPENYVVFL

SEQ ID NO: 15559 - protein, 548 aa, Homo sapiens
MQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 15560 - protein, 399 aa, Homo sapiens
MVDIIAKVTRRQSRALPAQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELVSRAQGL

SEQ ID NO: 15561 - protein, 548 aa, Homo sapiens; identical to SEQ ID NO: 15559

SEQ ID NO: 15562 - protein, 862 aa, Homo sapiens
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRTSSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 15563 - protein, 263 aa, Homo sapiens
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRTSSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVPPRALGRGGGWRARDRARTEPGRKETRSAQRRARRPPLSEDFG

SEQ ID NO: 15564 - protein, 841 aa, Homo sapiens
MSAQSLPAATPPTQKPPRIIRPRPPSRSRAAQSPGPPHNGSSPQELPRNSNDAPTPMCTPIFWEPPAASLKPPALLPPSASRASLDSQTSPDSPSSTPTPSPVSRRSASPEPAPRSPVPPPKPSGSPCTPLLPMAGVLAQNGSASAPGTVRRLAGRFEGGAEGRAQDADAPEPGLQARADVNGEREAPLTGSGSQENGAPDAGLACPPCCPCVCHTTRPGLELRWVPVGGYEEVPRVPRRASPLRTSRSRPHPPSIGHPAVVLTSYRSTAERKLLPLLKPPKPTRVRQDATIFGDPPQPDLDLLSEDGIQTGDSPDEAPQNTPPATVEGREEEGLEVLKEQNWELPLQDEPLYQTYRAAVLSEELWGVGEDGSPSPANAGDAPTFPRPPGPRNTLWQELPAVQASGLLDTLSPQERRMQESLFEVVTSEASYLRSLRLLTDTFVLSQALRDTLTPRDHHTLFSNVQRVQGVSERFLATLLSRVRSSPHISDLCDVVHAHAVGPFSVYVDYVRNQQYQEETYSRLMDTNVRFSAELRRLQSLPKCERLPLPSFLLLPFQRITRLRMLLQNILRQTEEGSSRQENAQKALGAVSKIIERCSAEVGRMKQTEELIRLTQRLRFHKVKALPLVSWSRRLEFQGELTELGCRRGGVLFASRPRFTPLCLLLFSDLLLITQPKSGQRLQVLDYAHRSLVQAQQVPDPSGPPTFRLSLLSNHQGRPTHRLLQASSLSDMQRWLGAFPTPGPLPCSPDTIYEDCDCSQELCSESSAPAKTEGRSLESRAAPKHLHKTPEGWLKGLPGAFPAQLVCEVTGEHERRRHLRQNQRLLEAVGSSSGTPNAPPP

SEQ ID NO: 15565 - protein, 841 aa, Homo sapiens; identical to SEQ ID NO: 15564

SEQ ID NO: 15566 - protein, 631 aa, Homo sapiens
MAPLHKNYPETPMMHQPQCAPPSSGSPQLHPSSPLLFCPPQNGSASAPGTVRRLAGRFEGGAEGRAQDADAPEPGLQARADVNGEREAPLTGSGSQENGAPGDSPDEAPQNTPPATVEGREEEGLEVLKEQNWELPLQDEPLYQTYRAAVLSEELWGVGEDGSPSPANAGDAPTFPRPPGPRNTLWQELPAVQASGLLDTLSPQERRMQESLFEVVTSEASYLRSLRLLTDTFVLSQALRDTLTPRDHHTLFSNVQRVQGVSERFLATLLSRVRSSPHISDLCDVVHAHAVGPFSVYVDYVRNQQYQEETYSRLMDTNVRFSAELRRLQSLPKCERLPLPSFLLLPFQRITRLRMLLQNILRQTEEGSSRQENAQKALGAVSKIIERCSAEVGRMKQTEELIRLTQRLRFHKVKALPLVSWSRRLEFQGELTELGCRRGGVLFASRPRFTPLCLLLFSDLLLITQPKSGQRLQVLDYAHRSLVQAQQVPDPSGPPTFRLSLLSNHQGRPTHRLLQASSLSDMQRWLGAFPTPGPLPCSPDTIYEDCDCSQELCSESSAPAKTEGRSLESRAAPKHLHKTPEGWLKGLPGAFPAQLVCEVTGEHERRRHLRQNQRLLEAVGSSSGTPNAPPP

SEQ ID NO: 15567 - protein, 871 aa, Homo sapiens
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTSLTQVEIVRSFTAKQPDELSLQVADVVLIYQRVSDGWYEGERLRDGERGWFPMECAKEITCQATIDKNVERMGRLLGLETNV

SEQ ID NO: 15568 - protein, 871 aa, Homo sapiens; identical to SEQ ID NO: 15567

SEQ ID NO: 15569 - protein, 446 aa, Homo sapiens
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKVILIVGFMEMKDGRLRGGK

SEQ ID NO: 15570 - protein, 791 aa, Homo sapiens
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTCG

SEQ ID NO: 15571 - protein, 870 aa, Homo sapiens
MEKTKTKQGENEHMPVNNPSTQIYQLQALASELKTGFTEAMQELSRIQHGEYALEEKVKSCRCSMEEKVTEMKNSLNYFKEELSNAMSMIQAITSKQEEMQQKIEQLQQEKRRESRKVKAKKTQKEEHSSQAGPAQAQGSPFRSINIPEPVLPSEDFTNLLPSQAYEKAQESRSVHVGDSNVKGMMGPGVNPTTPEAEENLKSCLSADIQSKGHLPSGMWRQPKDGKEWGEEYVTKDHPDKLKEAGQGRHSSLENVLCETSLAAKRQTVALELLESERKYVINISLILKIKATFQGSDGKRNSKERSLFPGSLRYLVQQHLDLLHALQERVLKWPRQGVLGDLFLKLTNDENNFLDYYVAYLRDLPECISLVHVVVLKEGDEEIKSDIYTLFFHIVQRIPEYLIHLQNVLKFTEQEHPDYYLLLVCVQRLRVFISHYTLLFQCNEDLLIQKRKKLKKSSMAKLYKGLASQCANAGQDASPTAGPEAVRDTGIHSEELLQPYPSAPSSGPAITHLMPPVKKSQQQQSLMESMQPGKPSDWELEGRKHERPESLLAPTQFCAAEQDVKALAGPLQAIPEMDFESSPAEPLGNVERSLRAPAELLPDARGFVPAAYEEFEYGGEIFALPAPYDEEPFQAPALFENCSPASSESSLDICFLRPVSFAMEAERPEHPLQPLPKSATSPAGSSSAYKLEAAAQAHGKAKPLSRSLKEFPRAPPADGVAPRLYSTRSSSGGRAPIKAERAAQAHGPAAAAVAARGASRTFFPQQRSQSEKQTYLEVRREMHLEDTTRFCPKEERESEQTSFSDQNPRQDQKGGFRSSFRKLFKKKSSGSEYREKTNENPSMDPSPTKQDFFRNRLALANDLDQGTAV

SEQ ID NO: 15572 - protein, 844 aa, Homo sapiens
MEKTKTKQGENEHMPVNNPSTQIYQLQALASELKTGFTEAMQELSRIQHGEYALEEKVKSCRCSMEEKVTEMKNSLNYFKEELSNAMSMIQAITSKQEEMQQKIEQLQQEKRRESRKVKAKKTQKEEHSSQAGPAQAQGSPFRSINIPEPVLPSEDFTNLLPSQAYEKAQESRSVHVGDSNVKGMMGPGVNPTTPEAEENLKSCLSADIQSKGHLPSGMWRQPKDGKEWGEEYVTKDHPDKLKEAGQGRHSSLENVLCETSLAAKRQTVALELLESERKYVINISLILKIKATFQGSDGKRNSKERSLFPGSLRYLVQQHLDLLHALQERVLKWPRQGVLGDLFLKLTNDENNFLDYYVAYLRDLPECISLVHVVVLKEGDEEIKSDIYTLFFHIVQRIPEYLIHLQNVLKFTEQEHPDYYLLLVCVQRLRVFISHYTLLFQCNEDLLIQKRKKLKKSSMAKLYKGLASQCANAGQDASPTAGPEAVRDTGIHSEELLQPYPSAPSSGPAITHLMPPVKKSQQQQSLMESMQPGKPSDWELEGRKHERPESLLAPTQFCAAEQDVKALAGPLQAIPEMDFESSPAEPLGNVERSLRAPAELLPDARGFVPAAYEEFEYGGEIFALPAPYDEEPFQAPALFENCSPASSESSLDICFLRPVSFAMEAERPEHPLQPLPKSATSPAGSSSAYKLEAAAQAHGKAKPLSRSLKEFPRAPPADGVAPRLYSTRSSSGGRAPIKAERAAQAHGPAAAAVAARGASRTFFPQQRSQSEKQTYLEVRREMHLEDTTRFCPKEERESEQTSFSDQNPRQDQKGGFRSSFRKLFKKKNGNATGEDFCGPWGWW

SEQ ID NO: 15573 - protein, 870 aa, Homo sapiens; identical to SEQ ID NO: 15571

SEQ ID NO: 15574 - protein, 484 aa, Homo sapiens
MEAEEAQHGASPPISAIEEFSIIPEAPMRSSQVSALGLEAQEDEDPSYKWREEHRLSATQQSELRDVCDYAIETMPSFPKEGSADVEPNQESLVAEACDTPEHWEAVPQSLAGRQARTLAPPELWACPIQSEHLDMAPFSSDLGSEEEEVEFWPGLTSLTLGSGQAEEEEETSSDNSGQTRYYSPCEEHPAETNQNEGAESGTIRQGEELPSEELQESQGLLHPQEVQVLEEQGQQEAGFRGEGTLREDVCADGLLGEEQMIEQVNDEKGEQKQKQEQVQDVMLGRQGERMGLTGEPEGLNDGEWEQEDMERKAQGQGGPEQGEERKRELQVPEENRADSQDEKSQTFLGKSEEVTGKQEDHGIKEKGVPVSGQEAKEPESWDGGRLGAVGRARSREEENEHHGPSMPALIAPEDSPHCDLFPGASYLVTQIPGTQTESRAEELSPAALSPLLEPIRCSHQPISLLGSFLTEESPDKEKLLSVL

SEQ ID NO: 15575 - protein, 484 aa, Homo sapiens; identical to SEQ ID NO: 15574

SEQ ID NO: 15576 - protein, 223 aa, Homo sapiens
MLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPASGLCYVQNHFGPNPTSSSVYPASAGTSLGIQPPTPVNSPGTVYSGALGTPGAAGSKESSRVPMP

SEQ ID NO: 15577 - protein, 670 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSPATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 15578 - protein, 181 aa, Homo sapiens
MYNIKQSTDTKEAAAIEARRNREKERQNRFFNVRNRVMGVDVQALNNQVGDRKRREAAERSKEAAYGTSQVQYDVVVQMLEKEEADRTRQLAKKVQEFREQKQQLKNGREFSLWDPGQVWKGLPTYLSYSNTYPGPASLQYFSGEDLDRDTRLRMQQGQFRYNLERQQQEQQQAKVDENYT

SEQ ID NO: 15579 - protein, 379 aa, Homo sapiens
MYNIKQSTDTKEAAAIEARRNREKERQNRFFNVRNRVMGVDVQALNNQVGDRKRREAAERSKEAAYGTSQVQYDVVVQMLEKEEADRTRQLAKKVQEFREQKQQLKNGREFSLWDPGQVWKGLPTYLSYSNTYPGPASLQYFSGEDLDRDTRLRMQQGQFRYNLERQQQEQQQAKVDENYTDALSNQLRLAMDAQATHLARLEESCRAAMMCAMANANKAQAAVQAGRQRCERQREQKANLAEIQHQSTSDLLTENPQVAQHPMAPYRVLPYCWKGMTPEQQAAIRKEQEVQRSKKQAHRQAEKTLDTEWKSQTMSSAQAVLELEEQERELCAVFQRGLGSFNQQLANEQKAQQDYLNSVIYTNQPTAQYHQQFNTSSR

SEQ ID NO: 15580 - protein, 238 aa, Homo sapiens
MYNIKQSTDTKEAAAIEARRNREKERQNRFFNVRNRVMGVDVQALNNQVGDRKRREAAERSKEAAYDALSNQLRLAMDAQATHLARLEESCRAAMMCAMANANKAQAAVQAGRQRCERQREQKANLAEIQHQSTSDLLTENPQVAQHPMAPYRVLPYCWKGMTPEQQAAIRKEQEVQRSKKQAHRQAEKTLDTEWKSQTMSSAQAVLELEEQERELCAVFQRGLGSFNQQLANEQKAQ

SEQ ID NO: 15581 - protein, 192 aa, Homo sapiens
MYNIKQSTDTKEAAAIEARRNREKERQNRFFNVRNRVMGVDVQALNNQVGDRKRREAAERSKEAAYGTSQVQYDVVVQMLEKEEADRTRQLAKKVQEFREQKQQLKNGREFSLWDPGQVWKGLPTYLSYSNTYPGPASLQYFSGEDLDRDTRLRMQQGQFRYNLERQQQEQQQAKVDENYTGKQPGPPDSET

SEQ ID NO: 15582 - protein, 309 aa, Homo sapiens
MRQNDKIMCILENRKKRDRKNLCRAINDFQQSFQKPETRREFDLSDPLALKKDLPARQSDNDVRNTISGMQKFMGEDLNFHERKKFQEEQNREWSLQQQREWKNARAEQKCAEALYTETRLQFDETAKHLQKLESTTRKAVCASVKDFNKSQAIESVERKKQEKKQEQEDNLAEITNLLRGDLLSENPQQAASSFGPHRVVPDRWKGMTQEQLEQIRLVQKQQIQEKLRLQEEKRQRDLDWDRRRIQGARATLLFERQQWRRQRDLRRALDSSNLSLAKEQHLQKKYMNEVYTNQPTGDYFTQFNTGSR

SEQ ID NO: 15583 - protein, 377 aa, Homo sapiens
MAVALPRDLRQDANLAKRRHAELCRQKRVFNARNRIIGGDTEAWDVQVHDQKIKEATEKARHETLAAEMRQNDKIMCILENRKKRDRKNLCRAINDFQQSFQKPETRREFDLSDPLALKKDLPARQSDNDVRNTISGMQKFMGEDLNFHERKKFQEEQNREWSLQQQREWKNARAEQKCAEALYTETRLQFDETAKHLQKLESTTRKAVCASVKDFNKSQAIESVERKKQEKKQEQEDNLAEITNLLRGDLLSENPQQAASSFGPHRVVPDRWKGMTQEQLEQIRLVQKQQIQEKLRLQEEKRQRDLDWDRRRIQGARATLLFERQQWRRQRDLRRALDSSNLSLAKEQHLQKKYMNEVYTNQPTGDYFTQFNTGSR

SEQ ID NO: 15584 - protein, 143 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNP

SEQ ID NO: 15585 - protein, 184 aa, Homo sapiens [sequence omitted]

SEQ ID NO: 15586 - protein, 146 aa, Homo sapiens
MHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 15587 - protein, 174 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKK

SEQ ID NO: 15588 - protein, 194 aa, Homo sapiens [sequence omitted]

SEQ ID NO: 15589 - protein, 295 aa, Homo sapiens
MSGALDVLQMKEEDVLKFLAAGTHLGGTNLDFQMEHYIYKRKSDGIYIINLKRTWEKLLLAARAIVAIENPADVSVISSRNTGQRAVLKFAAATGATPIAGRFTPGTFTNQIQAAFWEPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPSPEFTATQPEVADWSEGVQVPSVPIQQFPTEDWSAQPATEDWSAAPTAQATEWVGATTDWS

SEQ ID NO: 15590 - protein, 280 aa, Homo sapiens
MVARRRKCAARDPEDRIPSPLGYAAIPIKFSEKQQASHYLYVRAHGVRQGTKSTWPQKRTLFVLNVPPYCTEESLSRLLSTCGLVQSVELQEKPDLAESPKESRSKFFHPKPVPGFQVAYVVFQKPSGVSAALALKGPLLVSTESHPVKSGIHKWISDYADSVPDPEALRVEVDTFMEAYDQKIAEEEAKAKEEEGVPDEEGWVKVTRRGRRPVLPRTEAASLRVLERERRKRSRKELLNFYAWQHRESKMEHLAQLRKKFEEDKQRIELLRAQRKFRPY

SEQ ID NO: 15591 - protein, 244 aa, Homo sapiens
MAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVSVEYTEKMVSISNYPLSAALTCAKLTTAFEEVWGVI

SEQ ID NO: 15592 - protein, 157 aa, Homo sapiens
MNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 15593 - protein, 210 aa, Homo sapiens
MLKCFRNCLRPSSLSTLPLQYGILFPKLLACLVHLHFGHFSSAVISVTSFYLSMNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 15594 - protein, 210 aa, Homo sapiens; identical to SEQ ID NO: 15593

SEQ ID NO: 15595 - protein, 118 aa, Homo sapiens
MNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQR

SEQ ID NO: 15596 - protein, 343 aa, Homo sapiens
MAEQLSPGKAVDQVCTFLFKKPGRKGAAGRRKRPACDPEPGESGSSSDEGCTVVRPEKKRVTHNPMIQKTRDSGKQKAAYGDLSSEEEEENEPESLGVVYKSTRSAKPVGPEDMGATAVYELDTEKERDAQAIFERSQKIQEELRGKEDDKIYRGINNYQKYMKPKDTSMGNASSGMVRKGPIRAPEHLRATVRWDYQPDICKDYKETGFCGFGDSCKFLHDRSDYKHGWQIERELDEGRYGVYEDENYEVGSDDEEIPFKCFICRQSFQNPVVTKCRHYFCESCALQHFRTTPRCYVCDQQTNGVFNPAKELIAKLEKHRATGEGGASDLPEDPDEDAIPIT

SEQ ID NO: 15597 - protein, 322 aa, Homo sapiens
MAAPPSPGRTADQADQVCTFLFKKPGRKGAAGLRKRPACDPEHGESSSSGDEGDTVAQPPRVAPRPRGLHSWQKAAHGDRRGEEAAPESLDVVYRSTRSAKPVGPEDMGATADFEQDTEKEHHTPTILKCSQRVQEALRGREHDHIYRGIHSYLRYLKPKDTSMGNSSSGMARKGPIRAPGHLRATVRWDYQPDICKDYKETGFCGFGDSCKFLHDRSDYKLGWEIERELEEGRYCICEDENHEVGSEEEEIPFRCFICRQAFQNPVVTKCRHYFCESCALEHFRATPRCYICDQPTGGIFNPAKELMAKLQKLQAAEGKKR

SEQ ID NO: 15598 - protein, 232 aa, Homo sapiens
MGSVLSTDSGKSAPASATARALERRRDPELPVTSFDCAVCLEVLHQPVRTRCGHVFCRSCIATSLKNNKWTCPYCRAYLPSEGVPATDVAKRMKSEYKNCAECDTLVCLSEMRAHIRTCQKYIDKYGPLQELEETAARCVCPFCQRELYEDSLLDHCITHHRSERRPVFCPLCRLIPDENPSSFSGSLIRHLQVSHTLFYDDFIDFNIIEEALIRRVLDRSLLEYVNHSNTT

SEQ ID NO: 15599 - protein, 311 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 15600 - protein, 327 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATTWSPLGRPQPPRPLSNLTL

SEQ ID NO: 15601 - protein, 151 aa, Homo sapiens
MAEDLSAATSYTEDDFYCPVCQEVLKTPVRTTACQHVNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 15602 - protein, 245 aa, Homo sapiens
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 15603 - protein, 230 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKWSDRHRNCPICRLQMTGANESWVVSDAPTEDDMANYILNMADEAGQPHRP

SEQ ID NO: 15604 - protein, 180 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDK

SEQ ID NO: 15605 - protein, 679 aa, Homo sapiens
MGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 15606 - protein, 380 aa, Homo sapiens
MGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPPSLLKIQKISWAWLQAPVVPATWEAEAGEWPEPGRRSLQ

SEQ ID NO: 15607 - protein, 657 aa, Homo sapiens
MGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 15608 - protein, 346 aa, Homo sapiens
MVLVHVGYLVLPVFGSVRNRGAPFQRSQHPHATSCRHFHLGPPQPQQLAPDFPLAHPVQSQPGLSAHMAPAHQHSGALHQSLTPLPTLQFQDVTGPSFLPQALHQQYLLQQQLLEAQHRRLVSHPRRSQERVSVHPHRLHPSFDFGQLQTPQPRYLAEGTDWDLSVDAGLSPAQFQVRPIPQHYQHYLATPRMHHFPRNSSSTQMVVHEIRNYPYPQLHFLALQGLNPSRHTSAVRESYEELLQLEDRLGNVTRGAVQNTIERFTFPHKYKKRRPQDGKGKKDEGEESDTDEKCTICLSMLEDGEDVRRLPCMHLFHQLCVDQWLAMSKKCPICRVDIETQLGADS

SEQ ID NO: 15609 - protein, 154 aa, Homo sapiens
MHHFPRNSSSTQMVVHEIRNYPYPQLHFLALQGLNPSRHTSAVRESYEELLQLEDRLGNVTRGAVQNTIERFTFPHKYKKRRPQDGKGKKDEGEESDTDEKCTICLSMLEDGEDVRRLPCMHLFHQLCVDQWLAMSKKCPICRVDIETQLGADS

SEQ ID NO: 15610 - protein, 28 aa, Homo sapiens
MVLVHVGYLVLPVFGSVRNRGISVWMLA

SEQ ID NO: 15611 - protein, 237 aa, Homo sapiens
MAMFRSLVASAQQRQPPAGPAGGDSGLEAQYTCPICLEVYHRPVAIGSCGHTFCGECLQPCLQVPSPLCPLCRLPFDPKKVDKATHVEKQLSSYKAPCRGCNKKVTLAKMRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 15612 - protein, 156 aa, Homo sapiens
MAMFRSLVASAQQRQPPAGPAGGDSGLEAQYTCPICLEVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 15613 - protein, 128 aa, Homo sapiens
MRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 15614 - protein, 156 aa, Homo sapiens; identical to SEQ ID NO: 15612

SEQ ID NO: 15615 - protein, 708 aa, Homo sapiens
MAAAGPSTRASSAAAAAALSRRGRRGRCDETAAAKTGAPGPASGPSLLVLSPPLLQPPLPPRPEESGCAGCLEPPGEAAALPCGHSLCRGCAQRAADAAGPGCPRCRARGPGWARRRARDDGQADSEVLGECARRSQPERCRPRRDGGAAAAGPRPEQEPRAAPAEPDFIFRAPIKLSKPGELREEYESLRKLREEKLQEEKPSEDQIHKLLPEDTETGKRKMDEQKKRDEPLVLKTNLERCPARLSDSENEEPSRGQMTQTHRSAFVSKNNSYSLAFLAGKLNSKVERSQSCSDTAQERAKSRVRAVPGNKAKVTTMTPASNPIIGVLLSTQNNRCVSAPDLTIEKRLPFSSLSSLASLHKPERSVSPESNDSISEELNHFKPIVCSPCTPPKRLPDGRVLSPLIIKSTPRNLNRSLQKQTSYEASPRILKKWEQIFQERQIKKTLSKATLTSLAPEMGEELLGSEGIHSSKEKPLVAVNTRLSGGQVLSEYTGPTSADLDHFPSVSQTKAEQDSDNKSSTEIPLETCCSSELKGGGSGTSLEREQFEGLGSTPDAKLDKTCISRAMKITTVNSVLPQNSVLGGVLKTKQQLKTLNHFDLTNGVLVESLSEEPLPSLRRGRKRHCKTKHLEQNGSLKKLRQTSGEVGLAPTDPVLREMEQKLQQEEEDRQLALQLQRMFDNERRTVSRRKGSVDQYLLRSSNMAGAK

SEQ ID NO: 15616 - protein, 79 aa, Homo sapiens
  MOD_RES (1)..(1): Any amino acid
XLEQNGSLKKLRQTSGEVGLAPTDPVLREMEQKLQQEEEDRQLALQLQRMFDNERRTVSRRKGSVDQYLLRSSNMAGAK

SEQ ID NO: 15617 - protein, 192 aa, Homo sapiens
MAEQQGRELEAECPVCWNPFNNTFHTPKMLDCCHSFCVECLAHLSLVTPARRRLLCPLCRQPTVLASGQPVTDLPTDTAMLALLRLEPHHVILEGHQLCLKDQPKSRYFLRQPQVYTLDLGPQPGGQTGPPPDTASATVSTPILIPSHHSLRECFRNPQFRIFAYLMAVILSVTLLLIFSIFWTKQFLWGVG

SEQ ID NO: 15618 - protein, 192 aa, Homo sapiens; identical to SEQ ID NO: 15617

SEQ ID NO: 15619 - protein, 192 aa, Homo sapiens; identical to SEQ ID NO: 15617

SEQ ID NO: 15620 - protein, 192 aa, Homo sapiens; identical to SEQ ID NO: 15617

SEQ ID NO: 15621 - protein, 634 aa, Homo sapiens
MSGAIFGPLEGPSSLDAPSIHPLVCPLCHVQYERPCLLDCFHDFCAGCLRGRATDGRLTCPLCQHQTVLKGPSGLPPVDRLLQFLVDSSGDGVEAVRCANCDLECSEQDVETTYFCNTCGQPLCARCRDETHRARMFARHDIVALGQRSRDVPQKCTLHAEPYLLFSTDKKLLLCIRCFRDMQKESRAHCVDLESAYVQGCERLEQAVLAVKALQTATREAIALLQAMVEEVRHSAAEEEDAIHALFGSMQDRLAERKALLLQAVQSQYEEKDKAFKEQLSHLATLLPTLQVHLVICSSFLSLANKAEFLDLGYELMERLQGIVTRPHHLRPIQSSKIASDHRAEFARCLEPLLLLGPRRVAAAASGANTLAGGLGPKALTGPHCPSPVGKMSGSPVQKPTLHRSISTKVLLAEGENTPFAEHCRHYEDSYRHLQAEMQSLKDQVQELHRDLTKHHSLIKAEIMGDVLHKSLQLDVQIASEHASLEGMRVVFQEIWEEAYQRVANEQEIYEAQLHDLLQLRQENAYLTTITKQITPYVRSIAKVKERLEPRFQAPVDEQSESLQNTHDDSRNNAASARNNPGSVPEKREKTSEPKGNSWAPNGLSEEPLLKNMDHHRSKQKNGGDVPTWREHPT

SEQ ID NO: 15622 - protein, 144 aa, Homo sapiens
MVEEVRHSAAEEEDAIHALFGSMQDRLAERKALLLQAVQSQYEEKDKAFKEQLSHLATLLPTLQVHLVICSSFLSLANKAEFLDLGYAGRGLRPQGADGAPLPLPSRKDVGVTRPKAHAAPVHQHQGAAGGGREHALRRALPPL

SEQ ID NO: 15623 - protein, 261 aa, Homo sapiens
MPSDPGPEAGSGWPGLLMSCLKGPHVILKMEAMKIVHPEKFPELPAAPCFPPAPRPTPTLAPKRAWPSDTEIIVNQACGGDMPALEGAPHTPPLPRRPRKGSSELGFPRVAPEDEVIVNQYVIRPGPSASAASSAAAGEPLECPTCGHSYNVTQRRPRVLSCLHSVCEQCLQILYESCPKYKFISCPTCRRETVLFTDYGLAALAVNTSILSRLPPEALTAPSGGQWGAEPEGSCYQTFRQYCGAACTCHVRNPLSACSIM

SEQ ID NO: 15624 - protein, 261 aa, Homo sapiens; identical to SEQ ID NO: 15623

SEQ ID NO: 15625 - protein, 703 aa, Homo sapiens
MAASEVAGVVANAPSPPESSSLCASKSDEGLPDGLSTKDSAQKQKNSPLLSVSSQTITKENNRNVHLEHSEQNPGSSAGDTSAAHQVVLGENLIATALCLSGSGSQSDLKDVASTAGEEGDTSLRESLHPVTRSLKAGCHTKQLASRNCSEEKSPQTSILKEGNRDTSLDFRPVVSPANGVEGVRVDQDDDQDSSSLKLSQNIAVQTDFKTADSEVNTDQDIEKNLDKMMTERTLLKERYQEVLDKQRQVENQLQVQLKQLQQRREEEMKNHQEILKAIQDVTIKREETKKKIEKEKKEFLQKEQDLKAEIEKLCEKGRREVWEMELDRLKNQDGEINRNIMEETERAWKAEILSLESRKELLVLKLEEAEKEAELHLTYLKSTPPTLETVRSKQEWETRLNGVRIMKKNVRDQFNSHIQLVRNGAKLSSLPQIPTPTLPPPPSETDFMLQVFQPSPSLAPRMPFSIGQVTMPMVMPSADPRSLSFPILNPALSQPSQPSSPLPGSHGRNSPGLGSLVSPHGPHMPPAASIPPPPGLGGVKASAETPRPQPVDKLEKILEKLLTRFPQCNKAQMTNILQQIKTARTTMAGLTMEELIQLVAARLAEHERVAASTQPLGRIRALFPAPLAQISTPMFLPSAQVSYPGRSSHAPATCKLCLMCQKLVQPSELHPMACTHVLHKECIKFWAQTNTNDTCPFCPTLK

SEQ ID NO: 15626 - protein, 703 aa, Homo sapiens; identical to SEQ ID NO: 15625

SEQ ID NO: 15627 - protein, 146 aa, Homo sapiens
MAASEVAGVVANAPSPPESSSLCASKSDEGLPDGLSTKDSAQKQKNSPLLSVSSQTITKENNRNVHLEHSEQNPGSSAGDTSAAHQVVLGENLIATALCLSGSGSQSDLKDVASTAGEEGDTSLRESLHPVTRSLKAGCHTKQLAS

SEQ ID NO: 15628 - protein, 726 aa, Homo sapiens
MAQTVQNVTLSLTLPITCHICLGKVRQPVICINNHVFCSICIDLWLKNNSQCPACRVPITPENPCKEIIGGTSESEPMLSHTVRKHLRKTRLELLHKEYEDEIDCLQKEVEELKSKNLSLESQIKTILDPLTLVQGNQNEDKHLVTDNPSKINPETVAEWKKKLRTANEIYEKVKDDVDKLKEANKKLKLENGGLVRENLRLKAEVDNRSPQKFGRFAVAALQSKVEQYERETNRLKKALERSDKYIEELESQVAQLKNSSEEKEAMNSICQTALSADGKGSKGSEEDVVSKNQGDSARKQPGSSTSSSSHLAKPSSSRLCDTSSARQESTSKADLNCSKNKDLYQEQVEVMLDVTDTSMDTYLEREWGNKPSDCVPYKDEELYDLPAPCTPLSLSCLQLSTPENRESSVVQAGGSKKHSNHLRKLVFDDFCDSSNVSNKDSSEDDISRSENEKKSECFSSPKTGFWDCCSTSYAQNLDFESSEGNTIANSVGEISSKLSEKSGLCLSKRLNSIRSFEMNRTRTSSEASMDAAYLDKISELDSMMSESDNSKSPCNNGFKSLDLDGLSKSSQGSEFLEEPDKLEEKTELNLSKGSLTNDQLENGSEWKPTSFFLLSPSDQEMNEDFSLHSSSCPVTNEIKPPSCLFQTEFSQGILLSSSHRLFEDQRFGSSLFKMSSEMHSLHNHLQSPWSTSFVPEKRNKNVNQSTKRKIQSSLSSASPSKATKS

SEQ ID NO: 15629 - protein, 220 aa, Homo sapiens
MSEGESKDSSGSECPVCYEKFRDLEGASRTLSCGHVFCHDCLVKYLLSTRVDGQVQRTLVCPICRYVTFLSKKSSRWPSMLDKSSQTLAVPVGLPSVPPLDSLGHTNPLAASSPAWRPPPGQARPPGSPGQSAQLPLDLLPSLPRESQIFVISRHGMPLGEQDSVLPRRSLAELSEASLAPRSARAFCCRSRALLLITLIAVVAVVAAILPWVLLVRKQA

SEQ ID NO: 15630 - protein, 220 aa, Homo sapiens; identical to SEQ ID NO: 15629

SEQ ID NO: 15631 - protein, 156 aa, Homo sapiens
MQDAAAGGPPGLGGGGPPEERTDCIICCSAYDLSGHLPRRLYCGHTFCQACVRRLDTPAPEQRWIPCPQCRQSTPTPRGGVAMLDLDLAAFLAVKAEREPARLEPLPLTSLKGSAITRQPAGLCPALGPQPHFPQPRYCCWGCGSLCCPPLGSPEV

SEQ ID NO: 15632 - protein, 317 aa, Homo sapiens
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERSWPQGLATLETRQMNRRYYENYVAKRIPGKQAVVVMACENQHMGDDMVQEPGLVMIFAHGVEEI

SEQ ID NO: 15633 - protein, 246 aa, Homo sapiens
MRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERSWPQGLATLETRQMNRRYYENYVAKRIPGKQAVVVMACENQHMGDDMVQEPGLVMIFAHGVEEI

SEQ ID NO: 15634 - protein, 304 aa, Homo sapiens
MGYDVTRFQGDVDEDLICPICSGVLEEPVQAPHCEHAFCNACITQWFSQQQTCPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERSWPQGLATLETRQMNRRYYENYVAKRIPGKQAVVVMACENQHMGDDMVQEPGLVMIFAHGVEEI

SEQ ID NO: 15635 - protein, 190 aa, Homo sapiens
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNL

SEQ ID NO: 15636 - protein, 146 aa, Homo sapiens
MRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGM

SEQ ID NO: 15637 - protein, 201 aa, Homo sapiens
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILE

SEQ ID NO: 15638 - protein, 317 aa, Homo sapiens; identical to SEQ ID NO: 15632

SEQ ID NO: 15639 - protein, 432 aa, Homo sapiens
MRPWALAVTRWPPSAPVGQRRFSAGPGSTPGQLWGSPGLEGPLASPPARDERLPSQQPPSRPPHLPVEERRASAPAGGSPRMLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMPLQRLDNDVDLRGDQPSLGSFTYSTSAPGPALSPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKANRTCPICRADASEVPREAE

SEQ ID NO: 15640 - protein, 351 aa, Homo sapiens
MLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMPLQRLDNDVDLRGDQPSLGSFTYSTSAPGPALSPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKANRTCPICRADASEVPREAE

SEQ ID NO: 15641 - protein, 568 aa, Homo sapiens
MDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFRFRHGYCKGNPRKMVKTWAEKEMRNLIRLNTAEIPCPEPIMLRSHVLVMSFIGKDDMPAPLLKNVQLSESKARELYLQVIQYMRRMYQDARLVHADLSEFNMLYHGGGVYIIDVSQSVEHDHPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNILYQTVTGLKKDLSGVQKVPALLENQVEERTCSDSEDIGSSECSDTDSEEQGDHARPKKHTTDPDIDKKERKKMVKEAQREKRKNKIPKHVKKRKEKTAKTKKGK

SEQ ID NO: 15642 - protein, 552 aa, Homo sapiens
MGKVNVAKLRYMSRDDFRVLTAVEMGMKNHEIVPGSLIASIASLKHGGCNKVLRELVKHKLIAWERTKTVQGYRLTNAGYDYLALKTLSSRQVVESVGNQMGVGKESDIYIVANEEGQQFALKLHRLGRTSFRNLKNKRDYHKHRHNVSWLYLSRLSAMKEFAYMKALYERKFPVPKPIDYNRHAVVMELINGYPLCQIHHVEDPASVYDEAMELIVKLANHGLIHGDFNEFNLILDESDHITMIDFPQMVSTSHPNAEWYFDRDVKCIKDFFMKRFSYESELFPTFKDIRREDTLDVEVSASGYTKEMQADDELLHPLGPDDKNIETKEGSEFSFSDGEVAEKAEVYGSENESERNCLEESEGCYCRSSGDPEQIKEDSLSEESADARSFEMTEFNQALEEIKGQVVENNSVTEFSEEKNRTENYNRQDGQRVQGGVPAGSDEYEDECPHLIALSSLNREFRPFRDEENVGAMNQYRTRTLSITSSGSAVSCSTIPPELVKQKVKRQLTKQQKSAVRRRLQKGEANIFTKQRRENMQNIKSSLEAASFWGE

SEQ ID NO: 15643 - protein, 474 aa, Homo sapiens
MGKVNVAKLRYMSRDDFRVLTAVEMGMKNHEIVPGSLIASIASLKHGGCNKVLRELVKHKLIAWERTKTVQGYRLTNAGYDYLALKTLSSRQVVESVGNQMGVGKESDIYIVANEEGQQFALKLHRLGRTSFRNLKNKRDYHKHRHNVSWLYLSRLSAMKEFAYMKALYERKFPVPKPIDYNRHAVVMELINGYPLCQIHHVEDPASVYDEAMELIVKLANHGLIHGDFNEFNLILDESDHITMIDFPQMVSTSHPNAEWYFDRDVKCIKDFFMKRFSYESELFPTFKDIRREDTLDVEVSASGYTKEMQADDELLHPLGPDDKNIETKEGSEFSFSDGEVAEKAEVYGSENESERNCLEESEGCYCRSSGDPEQIKEDSLSEESADARSFEMTEFNQALEEIKGQVVENNSVTEFSEEKNRTENYNRQDGQRVQGGVPAGSDEYEDECPHLIALSSLNREFRPFRYRLLSIAF

SEQ ID NO: 15644 - protein, 519 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 15645 - protein, 415 aa, Homo sapiens
MNVTSIALRAETWLLAAWHVKVPPMWLEACINWIQEENNNVNLSQAQMNKQVFEQWLLTDLRDLEHPLLPDGILEIPKGELNGFYALQINSLVDVSQPAYSQIQKLRGKNTTNDLVTAEAQVTPKPWEAKPSRMLMLQLTDGIVQIQGMEYQPIPILHSDLPPGTKILIYGNISFRLGVLLLKPENVKVLGGEVDALLEEYAQEKVLARLIGEPDLVVSVIPNNSNENIPRVTDVLDPALGPSDEELLASLDENDELTANNDTSSERCFTTGSSSNTIPTRQSSFEPEFVISPRPKEEPSNLSIHVMDGELDDFSLEEALLLEETVQKEQMETKELQPLTFNRNADRSIERFSHNPNTTNNFSLTCKNGNNNWSEKNVSEQMTNEDKSFGCPSVRDQNRSIFSVHCNVPLAHDFT

SEQ ID NO: 15646 - protein, 339 aa, Homo sapiens
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDESKAYVIGGLVDHNHHKGLTYKQASDYGINHAQLPLGNFVKMNSRKVLAVNHVFEIILEYLETRDWQEAFFTILPQRKGAVPTDKACESASHDNQSVRMEEGGSDSDSSEEEYSRNELDSPHEEKQDKENHTESTVNSLPH

SEQ ID NO: 15647 - protein, 339 aa, Homo sapiens; identical to SEQ ID NO: 15646

SEQ ID NO: 15648 - protein, 339 aa, Homo sapiens; identical to SEQ ID NO: 15646

SEQ ID NO: 15649 - protein, 206 aa, Homo sapiens
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDESKAYVIG

SEQ ID NO: 15650 - protein, 200 aa, Homo sapiens
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDES

SEQ ID NO: 15651 - protein, 316 aa, Homo sapiens
MDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVE

SEQ ID NO: 15652 - protein, 229 aa, Homo sapiens
MDWKLEGSTQKVESPVLQGQEGILEETGEDGLPEGFQLLQIDAEGECQEGEILATGSTAWCSELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQETHNWPEALKKGVSSGKGYILRNSVE

SEQ ID NO: 15653 - protein, 256 aa, Homo sapiens
MDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKLDITEEDCFSLFPLETLVYLTPDSEHALEDVDLNKVYILGGLVDESIQKKVTFQKAREYSVKTARLPIQEYMVRNQNGKNYHSEILAINQETHNWPEALKKGVSSGKGYILRNSVE

SEQ ID NO: 15654 - protein, 157 aa, Homo sapiens
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 15655 - protein, 281 aa, Homo sapiens
MFPAQEEADRTVFVGNLEARVREEILYELFLQAGPLTKVTICKDREGKPKSFGFVCFKHPESVSYAIALLNGIRLYGRPINVQYRFGSSRSSEPANQSFESCVKINSHNYRNEEMLVGRSSFPMQYFPINNTSLPQEYFLFQKMQWHVYNPVLQLPYYEMTAPLPNSASVSSSLNHVPDLEAGPSSYKWTHQQPSDSDLYQMTAPLPNSASVSSSLNHVPDLEAGPSSYKWTHQQPSDSDLYQMNKRKRQKQTSDSDSSTDNNRGNECSQKFRKSKKKKRY

SEQ ID NO: 15656 - protein, 1001 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRPLKAENPYLFLRGLPYLVNEDDVRVFFSGLCVDGVIFLKHHDGRNNGDAIVKFASCVDASGGLKCHRSFMGSRFIEVMQGSEQQWIEFGGNAVKEGDVLRRSEEHSPPRGINDRHFRKRSHSKSPRRTRSRSPLGFYVHLKNLSLSIDERDLRNFFRGTDLTDEQIRFLYKDENRTRYAFVMFKTLKDYNTALSLHKTVLQYRPVHIDPISRKQMLKFIARYEKKRSGSLERDRPGHVSQKYSQEGNSGQKLCIYIRNFPFDVTKVEVQKFFADFLLAEDDIYLLYDDKGVGLGEALVKFKSEEQAMKAERLNRRRFLGTEVLLRLISEAQIQEFGVNFSVMSSEKMQARSQSRERGDHSHLFDSKDPPIYSVGAFENFRHQLEDLRQLDNFKHPQRDFRQPDRHPPEDFRHSSEDFRFPPEDFRHSPEDFRRPREEDFRRPSEEDFRRPWEEDFRRPPEDDFRHPREEDWRRPLEEDWRRPLEEDFRRSPTEDFRQLPEEDFRQPPEEDLRWLPEEDFRRPPEEDWRRPPEEDFRRPLQGEWRRPPEDDFRRPPEEDFRHSPEEDFRQSPQEHFRRPPQEHFRRPPPEHFRRPPPEHFRRPPPEHFRRPPPEHFRRPPPEHFRRPPPEHFRRPPQEHFRRPPQEHFRRSREEDFRHPPDEDFRGPPDEDFRHPPDEDFRSPQEEDFRCPSDEDFRQLPEEDLREAPEEDPRLPDNFRPPGEDFRSPPDDFRSHRPFVNFGRPEGGKFDFGKHNMGSFPEGRFMPDPKINCGSGRVTPIKIMNLPFKANVNEILDFFHGYRIIPDSVSIQYNEQGLPTGEAIVAMINYNEAMAAIKDLNDRPVGPRKVKLTLL

SEQ ID NO: 15657 - protein, 881 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRPLKAENPYLFLRGLPYLVNEDDVRVFFSGLCVDGVIFLKHHDGRNNGDAIVKFASCVDASGGLKCHRSFMGSRFIEVMQGSEQQWIEFGGNAVKEGDVLRRSEEHSPPRGINDRHFRKRSHSKSPRRTRSRSPLGFYVHLKNLSLSIDERDLRNFFRGTDLTDEQIRFLYKDENRTRYAFVMFKTLKDYNTALSLHKTVLQYRPVHIDPISRKQMLKFIARYEKKRSGSLERDRPGHVSQKYSQEGNSGQKLCIYIRNFPFDVTKVEVQKFFADFLLAEDDIYLLYDDKGVGLGEALVKFKSEEQAMKAERLNRRRFLGTEVLLRLISEAQIQEFGVNFSVMSSEKMQARSQSRERGDHSHLFDSKDPPIYSVGAFENFRHQLEDLRQLDNFKHPQRDFRQPDRHPPEDFRHSSEDFRFPPEDFRHSPEDFRRPREEDFRRPSEEDFRRPWEEDFRRPPEDDFRHPREEDWRRPPPEHFRRPPPEHFRRPPPEHFRRPPPEHFRRPPPEHFRRPPQEHFRRPPQEHFRRSREEDFRHPPDEDFRGPPDEDFRHPPDEDFRSPQEEDFRCPSDEDFRQLPEEDLREAPEEDPRLPDNFRPPGEDFRSPPDDFRSHRPFVNFGRPEGGKFDFGKHNMGSFPEGRFMPDPKINCGSGRVTPIKIMNLPFKANVNEILDFFHGYRIIPDSVSIQYNEQGLPTGEAIVAMINYNEAMAAIKDLNDRPVGPRKVKLTLL

SEQ ID NO: 15658 - protein, 143 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLR

SEQ ID NO: 15659 - protein, 149 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRP

SEQ ID NO: 15660 - protein, 122 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGY

SEQ ID NO: 15661 - protein, 82 aa, Homo sapiens
MAVVIRLLGLPFIAGPVDIRHFFTGLTIPDGGVHIIGGEIGEAFIIFATDEDARRAISRSGGFIKDSSVELFLSSKAEMQKT

SEQ ID NO: 15662 - protein, 190 aa, Homo sapiens
MEAETKTLPLENASILSEGSLQEGHRLWIGNLDPKITEYHLLKLLQKFGKVKQFDFLFHKSGALEGQPRGYCFVNFETKQEAEQAIQCLNGKLALSKKLVVRWAHAQVKRYDHNKNDKILPISLEPSSSTEPTQSNLSVTAKIKAIEAKLKMMAENPDAEYPAAPVYSYFKPPDKKRTTPYSRTAWKSRR

SEQ ID NO: 15663 - protein, 980 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 15664 - protein, 1007 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKVMQPLVQQPILPVVKQSVKERLGPVPSSTIEPAEAQSASSDLPQNVTKLSVKDRLGFVSKPSVSATEKVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 15665 - protein, 983 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKVMQPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 15666 - protein, 268 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLGNFFACLPSSFTLISTSSIVLL

SEQ ID NO: 15667 - protein, 106 aa, Homo sapiens
MHGRGRGVAGPMGRGRLMPNKQNLRVVECKPQPCVVSVEGLSSSTTDAQLKSLLMSVGPIQSLQMLPQQRKAIAKFKEPAHALAFQQKFHRHMIDLSHINVALIVE

SEQ ID NO: 15668 - protein, 1170 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQGPLHPPLPPPHQPQPQQPQQQPPPQHQPPHQPPHQPPPQHQPPPQHPPQHPPQHQHHHHHHHLSVPPPPLMPMSQPQFRPHVQTAQPQASSSRMQCPQRQGLRHNTTSQNVSKRPMQQMQPTAPRNSNLRELPIAPSHVIEMSSSRCSATPSAQVKPIVSASPPSRAVAGSRSSQGKTEVKVKPASPVAQPKEEAKTETEFPDEDEETRLYRLKIEEQKRLREEILKQKELRRQQQAGARKKELLERLAQQQQQLYAPPPPAEQEEQALSPSPTNGNPLLPFPGAQVRQNVKNRLLVKNQDVSISNVQPKTSNFVPSSANMQYQGQQMKALKHLRQTRTVPQSQTQPLHKVLPIKPADVEEPAVPQTPRVASIQGRPQDTKPGVKRTVTHRTNSGGGDGPHISSKVRVIKLSGGGGESDGFFHPEGQPQRLPQPPEVGPQPARKVTLTRGGLQQPPHLPAGPHAHSPVPPGIKSIQGIHPAKKAIMHGRGRGVAGPMGRGRLMPNKQNLRVVECKPQPCVVSVEGLSSSTTDAQLKSLLMSVGPIQSLQMLPQQRKAIAKFKEPAHALAFQQKFHRHMIDLSHINVALIVE

SEQ ID NO: 15669 - protein, 28 aa, Homo sapiens
MHGRGRGVAGPMGRGRLMPNKQNLRVVE

SEQ ID NO: 15670 - protein, 425 aa, Homo sapiens
MSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 15671 - protein, 311 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKDEPQKKNKGDPMNNLESFYQEMIMKKRLEEFQLMRGLTSFPREDFQNLSYEGTTSVLGAKWQKRTGRTSTFSILLVSLLSETVFTSSAMYGIPHLLTMSLKFSTRIGKLSFTP

SEQ ID NO: 15672 - protein, 413 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATGSTTEISGS

SEQ ID NO: 15673 - protein, 205 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKGIIPNPP

SEQ ID NO: 15674 - protein, 405 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATG

SEQ ID NO: 15675 - protein, 203 aa, Homo sapiens
  MOD_RES (1)..(1): Any amino acid
XVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKGIIPEEP

SEQ ID NO: 15676 - protein, 1052 aa, Homo sapiens
MMQATAVVETASGKGYHSNGGNLQKDKPSNPKKENLLLSSNGCDEVKLTFPDDDWNSSTLEQRANNKEISNIDKMDLLEPFFSVSQDTNTESTQFQSSELEDSTDYAFLNKTYSIPYSESKLKKESLTPLSSELDPEVQKKEEVFFNILEHQDKTVGLERIYNISDANYRESAEDTQKHDTDEDSQQEYHSAEEQEYISNHLSFDQTKALDISNPEVVELGNSGYEVKCASNVEDNRVNSGSGSIISFDSLDVYGQEESLHVSKFQNSVMLREYHDLKHEKYKEQETNSMYHTVFDGSVLRSNSPGNQESQSKSGSLSPQKVLKMKIYTENMKSQINEGKDFCGNKIVENKILLHLENPSTLPQDKALETLLQPCKDCQTSWTSVFDDSIISACGYYESLQNTADSALDFSAMLPKIAVRDNQAIEDNTSLKVAHSSTTKKTCFHNIGEMCTKSLTDAASCTVTINQTVDVSTDFRACFTTSRATSARPSVVSTSSNTEITMMNKKRPDEWQNEKQKSVACSTDWSYSEDCIDTQMAITKGSGKSLSVDSLKPNGNFLNKDFLELRKACGITDLKKHPEREFQLFKDTEKDLPSMCCQKIMQRAIKAELHLLNVHYQMCRRHCCDIYKLVMENREGLNMNLSSNSAKKELGSALLSLLGDLKVRYVTLKEKIHKGIPLEELPPLSLESKLLSTFSTFASRLMKKETHVFSEADAEQDNQRAHDVDVSSNLKKTLSQMSLSSDNSHATQNISPKKDDFKNGDINADFSQLKLGDKDCRHYQETSEDWSDAKESLTGVDVSGTQGNQVEQDTWNLDLTGEMKNVEPSQRDKGYLIHVGGLCPSVSEADLRSHFQKYQVSEISIYDSTNYRYASLAFTKNSDAKIAVKEMNGIEINGKSVNVWPVKILGEYTSPLSSKNGNRISSNNLEKSTNKQIHSEFSISRLPRTRPRQLGSEQDSEVFPSDQGVKKNCKQIESAKLLPDTPVQFIPPNTLNLRSFTKIIKRLAELHPEVSRDHIINALQEVRIRHKGFLNGLSITTIVEMTSSLLKNSASS

SEQ ID NO: 15677 - protein, 1052 aa, Homo sapiens; identical to SEQ ID NO: 15676

SEQ ID NO: 15678 - protein, 533 aa, Homo sapiens
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAEFNKFKPGAVERVKKLRDYAFVHFFNREDAVAAMSVMNGKCIDGASIEVTLAKPVNKENTWRQHLNGQISPNSENLIVFANKEESHPKTLGKLPTLPARLNGQHSPSPPEVERCTYPFYPGTKLTPISMYSLKSNHFNSAVMHLDYYCNKNNWAPPEYYLYSTTSQDGKVLLVYKIVIPAIANGSQSYFMPDKLCTTLEDAKELAAQFTLLHLDYNFHRSSINSLSPVSATLSSGTPSVLPYTSRPYSYPGYPLSPTISLANGSHVGQRLCISNQASFF

SEQ ID NO: 15679 - protein, 367 aa, Homo sapiens
MASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFGGLLHVCYAPEFETVEETRKKLQMRKAYVVKTTENKDHYVTKKKLVTEHKDTEDFRQDFHSEMSGFCKAALNTSAGNSNPYLPYSCELPLCYFSSKCMCSSGGPVDRAPDSSKDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVISSVPKPPEDKPEDVHTSHPLKQRRRI

SEQ ID NO: 15680 - protein, 360 aa, Homo sapiens [sequence omitted]

SEQ ID NO: 15681 - protein, 126 aa, Homo sapiens
GKMASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFWIASCVLCSRI

SEQ ID NO: 15682 - protein, 322 aa, Homo sapiens
MNPLTKVKLINELNEREVQLGVADKVSWHSEYKDSAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPSLSESSEDEKPTKKHKKDKKEKKKKKKEKEKADREVQAEQPSSSSPRRKTVKEKDDTGPKKHSSKNSERAQKSEPREGQKLPKSRTAYSGGAEDLERELKKEKPKHEHKSSSRREAREEKTRIRDRGRSSDAHSSWYNGRSEGRSYRSRSRSRDKSHRHKRARRSRERESSNPSDRWRH

SEQ ID NO: 15683 - protein, 58 aa, Homo sapiens
MNPLTKVKLINELNEREVQLGVADKVSWHSEYKDSAWIFLGGLPYELTEGDIICVFSQ

SEQ ID NO: 15684 - protein, 275 aa, Homo sapiens
MNPLTKVKLINELNEREVQLGVADKVSWHSEYKDSAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPSLSESSEDEKPTKKHKKDKKEKKKKKKEKEKADREVQAEQPSSSSPRRKTVKEKDDTGPKKHSSKNSERAQKSEPREGQKLPKSRTAYSGGAEDLERELKKEKPKHEHKSSSRREAREEKTRIRDRGLRCTF

SEQ ID NO: 15685 - protein, 1067 aa, Homo sapiens
MMEADRPEKLFIGGLNLKTDEKALKAEFGKYGHIIKVFLMKDRKTNKSRGFAFVTFESPADAKAAARDMNGKYLDGKAIMVAQTIKPAFKSSRWVPPTPGSGSRSRFSHRTRGGGSSPQRPPSQGRPDDGRGYAGYFDLWPYRAPMPRKRGPPPRHWASPPHKRATPSSLAHSVGCGMRGKAPTVSGQDGYSGLQPRRWAGPPHKRAVPRSSLARIGGSGMPGKAPAVWGQDGYSGPRVREPLPPCRDPGDFVPALRDYSRRYYGHSSVPDYRPLRGDGNQNGYRGRDHEYTDHPSKGSYREPLKSYGGPCGAAPVWGTPPSYGGGCRYEEYQGNSPDACSEGRSSEALPVVLPDAYSRDHSPKAYSGGRSSSSNGYSRSDRYGEEGCYEEYRGRSPDAHSGGRNSSSNSYGQSHHYGGEGRYEEYRGRSHEARSGGRSTDAHSRGRSDDAYSGGHDSSSWSDCCGGGGRYEEYQGRSLDANSGGCSPEAYSGGHDNSSWSDRYGVGGHYEENRGHSLDANSGGRSPDTHSGGHSSSSNSYGQSHRYGGEGRYEYRGRSHDAHSGGCSADAYSGGHDSSSQSNRYGGGGCYEEYRGRSLDANSGGRSPNAYSGGHDSSSWSHRYGGGGRYEEYRGRSLDANSGGRSPDAYSGGHDSSGQSNCYGGGGRYEEYRGRLLDANSGGRSPDAYSGGHDSSSQSNRYGGGGRYEEYRGHSLDANSGGRSPDTYSRGHDSSSQSDHYGGGGRSLDANSSGRLPDAYSGGHDSSSRSHRYGGGGRYEEYRGRSLDANSGGRSPNAYSGGHNSSSRNDPCRGGGRYEENRGHSLDANSGGHSPNAYSGGRDSSSNSYDRSHRYGGGGHYEEYRGRSHDTHSRGRSPDAHSGDHYTEAYSRGRDSFSNSYGRSDHYGRGGCYEEYQGRSPNAYGGGRGLNSSNNSHGRSHRYGGGGRYEEYRGPSPDAHSGGRDSSIKSYGLSDRYGGGGHYEEYQGSLPDAYSGDHDRSSNSYGRSDRYSRGRDRVGRPDRGLPLPMETGSPPLHDSYSRSGCRVPRGGGRQGGRFERGEGRSRY

SEQ ID NO: 15686 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 15687 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 15688 - protein, 496 aa, Homo sapiens; identical to SEQ ID NO: 15687

SEQ ID NO: 15689 - protein, 459 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 15690 - protein, 459 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYSYHDGYGEALGRDHSEHLSGSSYRDALQRYGTAHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 15691 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTAHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 15692 - protein, 496 aa, Homo sapiens; identical to SEQ ID NO: 15687

SEQ ID NO: 15693 - protein, 209 aa, Homo sapiens
MSNLKPDGEHGGSTGTGSGAGSGGALEEEVRTLFVSGLPVDIKPRELYLLFRPFKGYEGSLIKLTARQPVGFVIFDSRAGAEAAKNALNGIRFDPENPQTLRLEFAKANTKMAKSKLMATPNPSNVHPALGAHFIARDPYDLMGAALIPASPEAWAPYPLYTTELTPAISHAAFTYPTATAAAAALHAQVRWYPSSDTTQQGWKYRQFC

SEQ ID NO: 15694 - protein, 226 aa, Homo sapiens
MAAPLLHTRLPGDAAASPSAVKMLGASRTGISNMRALENDFFNSPPRKTVQFGGTVTEVLLKYKTGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTSQSLANNSKICTIDTVVSHANTGGKISICSKIRENTGMLRS

SEQ ID NO: 15695 - protein, 340 aa, Homo sapiens
MAAPLLHTRLPGDAAASPSAVKMLGASRTGISNMRALENDFFNSPPRKTVQFGGTVTEVLLKYKTGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTSQSLANNSKICTIECYVHNLLRISVYFPTLRHEILELIIEKLLKLDVNASRQGIEDAEETANQTCGGTDSTEGLCNMGFAEAFLEPLWKKLQDPSNPAIIRQAAGNYIGSFLARAKFIPLMIREQRHSAMLLSMDHFTQPAKLCSTPLFLDTSSF

SEQ ID NO: 15696 - protein, 486 aa, Homo sapiens
MAAPLLHTRLPGDAAASPSAVKMLGASRTGISNMRALENDFFNSPPRKTVQFGGTVTEVLLKYKTGETNDFELLKNQLLDPDIKRLPWLNRSQTVVEEYLAFLGNLVSAQTVFLRPCLSMIASHFVPPRVIIKEGDVDVSDSDDEDDNLPANFDTSQSLANNSKICTIECYVHNLLRISVYFPTLRHEILELIIEKLLKLDVNASRQGIEDAEETANQTCGGTDSTEGLCNMVSSLLMKVEMKFIIIKGWKQLVLLIFGFAEAFLEPLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFEWIVMSQLNPLKICLPSVVNFFAAITNKYQLVFCYTIIERNNRQMLPVIRSTTGGDSVQTCTNPLDTFFPFDPCVLKRSKKFIDPIYQVWEDMSAEELQEFKKPMKKLFWRIM

SEQ ID NO: 15697 - protein, 312 aa, Homo sapiens
MEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 15698 - protein, 545 aa, Homo sapiens
MWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQLEKEYVCRVEGEFPTEEVTCKEPILVVSYKVGVCRVDPRGKPCETVFQRLSYNGQSSVVRCRPLTGRTHQIRVHLQFLGHPILNDPIYNSVAWGPSRGRGGYIPKTNEELLRDLVAEHQAKQSLDVLDLCEGDLSPGLTDSTAPSSELGKDDLEELAAAAQKMEEVAEAAPQELDTIALASEKAVETDVMNQETDPLCAECRLVRQDPLPQDLVMFLHALRYKGPGFEYFSPMPAWAQDDWQKD

SEQ ID NO: 15699 - protein, 524 aa, Homo sapiens
MWLDRRGWLRVLGHWRYDLRRPSFTRTWSGDKGPMAETVSTQVGTEGGLRASHQQNGDAGGDAKVELSPGPPKPAGREVEPAPVARERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQLEKEYVCRVEGEFPTEEVTCKEPILVVSYKVGVCRVDPRGKPCETVFQRLSYNGQSSVVRCRPLTGRTHQIRVHLQFLGHPILNDPIYNSVAWGPSRGRGGYIPKTNEELLRDLVAEHQAKQSLDVLDLCEGDLSPGLTDSTAPSSELGKDDLEELAAAAQKMEEVAEAAPQELDTIALASEKAVETDVMNQETDPLCAECRLVRQDPLPQDLVMFLHALRYKGPGFEYFSPMPAWAQDDWQKD

SEQ ID NO: 15700 - protein, 351 aa, Homo sapiens
MRAVLAREMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 15701 - protein, 336 aa, Homo sapiens
MRAVLAREMDGRRVLGRFWSGWRRGLGVRPVPEDAGFGTEARHQRQPRGSCQRSGPLGDQPFAGLLPKNLSREELVDALRAAVVDRKGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 15702 - protein, 287 aa, Homo sapiens
MATVMAATAAERAVLEEEFRWLLHDEVHAVLKQLQDILKEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKISVFSSYWSYRPF

SEQ ID NO: 15703 - protein, 2226 aa, Homo sapiens
MVLAGLIRKLGHQLAEIRERALKSILCKIEHNLICYADLIQERQLFLHLLEWFNFPSVPMKEEVLNLLSRLVKYPPAVQHLVDVGAVEFLSKLRSNVEPNLQAEIDGILDGLFLLPSEVPALSSASYQTNQTELSKNPEILTGYFPQDKSNFQQMEVPPRPVVNQTVKCLKFSTFPWLPLTTTDRHVLSSNESSLRSSNHTLIWNTCELLKDVIMQDFPAEIFLQRPKIVQSLLSLLKLAFGDGKHRLALQSVSCLQQLCMYLRNRLNFHRDPGFFSNKHDTVSQNSSLSYCHEARGTHHSQNPSPGSSSPRPSVVGRTGQRPRGDGQDWDAASSSGSSSHAHVNSRISVHSPLDMGHIDLPELETEDTLELQFQQLSLPQFCVSILESAVPLLRTGSRQVIIRVLELLTEDMTLIGEAISTDIWDDSSLFGIDMKEKLLLVLGALGETMCYHKSSISLEQPEVMLVHHRMAFISISLFAVRLLQTLLPVEKASEFLSEPMSTALFLLSLDMPISLEYPNIHEAVVAYLEQLNSENYSIYKRTAEAVYSIECTCNFLSDIGKEGEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDEVSRMDMWSVNPSNKPSLPSVFSLPVSVFRRYHLPVHVIGHHAVSPYSIVLPLSADCLALKPVSDMLRIAWNLSWYHGSDNLLKQMNSETKTQEILDALKLSTEDILTLKITHMASGLQDCLHSIVQAATHREVRAAVTRMSFYLLNDRLSLKGCPGPCGVTLKSLAWHTALNRFLQVLPACTEDEKLLIDIIHFLNKLIKEQRKNSSLELLNWILELLLRHSANPLLDLLVLTESQAREETDDIRTAVRQQLQKELIALFDTLLLNFMEVTDRKCSELLYVFQTQLALKLLQCLKVTDAPHFYGLPSLERTLRGMANLTAFPGWSSHSPLTKPLDICVKYLSGLLEVITSFYVERGGNAMSFMGKGVTKSTILCLLHLSHEMMAQAGSLEWMSLWFLPLGSHSEEHIPTQQGLAWLIPLWVDRDPEVRFTSLGLGSALTTLETGCVALANSCQNISGGLWGTVVNILLDQSECSMVRREAAFILQNLLVIPMPTEIIKDYTWQGPCVHDEDSGLSLIGKPALQALLYHCHFYEHLNQMVKHCYLGRCMFDLNFSAFDRNSESNDLNGLDDSFKFWRAPSRTSQDRDPSSLSTSETTVAPSLGSTEFQPLVQSTTLLPEASHDQFVAQGHQESTSPRPPHDSSLSAPLPKLCVFVTPSLLSAMCSLLDNLLTIAPRDTAKAFRQAHLIELLCSIADATLIQTCVQELRALLPSSPPAEHTQAQVSFLLEYLSSLSRLLQSCLLVEPDLVIQDELVKPLITNIIGILTICTKDVLDKELISAFYHTWTHLFNLLAMLLRKAGAITLPFVTVALAKHWTAAIDMFCTCAGLSATCPALYTASLQFLSVLLTEEAKGHLQAKSKTHLCCSPTVASLLDDSQENQKSLEQLSDVILQCYEGKSSKDILKRVAANALMSLLAVSRRAQKHALKANLIDNCMEQMKHINAQLNLDSLRPGKAALKKKEDGVIKELSIAMQLLRNCLYQNEECKEAALEAHLVPVLHSLWPWILMDDSLMQISLQLLCVYTANFPNGCSSLCWSSCGQHPVQATHRGAVSNSLMLCILKLASQMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTFPNSEANPLNAYYLKCLENLVQLLNSS

SEQ ID NO: 15704 - protein, 1593 aa, Homo sapiens
MVLAGLIRKLGHQLAEIRERALKSILCKIEHNLICYADLIQERQLFLHLLEWFNFPSVPMKEEVLNLLSRLVKYPPAVQHLVDVGAVEFLSKLRSNVEPNLQAEIDGILDGLFLLPSEVPALSSASYQTNQTELSKNPEILTGYFPQDKSNFQQMEVPPRPVVNQTVKCLKFSTFPWLPLTTTDRHVLSSNESSLRSSNHTLIWNTCELLKDVIMQDFPAEIFLQRPKIVQSLLSLLKLAFGDGKHRLALQSVSCLQQLCMYLRNRLNFHRDPGFFSNKHDTVSQNSSLSYCHEARGTHHSQNPSPGSSSPRPSVVGRTGQRPRGDGQDWDAASSSGSSSHAHVNSRISVHSPLDMGHIDLPELETEDTLELQFQQLSLPQFCVSILESAVPLLRTGSRQVIIRVLELLTEDMTLIGEAISTDIWDDSSLFGIDMKEKLLLVLGALGETMCYHKSSISLEQPEVMLVHHRMAFISISLFAVRLLQTLLPVEKASEFLSEPMSTALFLLSLDMPISLEYPNIHEAVVAYLEQLNSENYSIYKRTAEAVYSIECTCNFLSDIGKEGEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDEVSRMDMWSVNPSNKPSLPSVFSLPVSVFRRYHLPVHVIGHHAVSPYSIVLPLSADCLALKPVSDMLRIAWNLSWYHGSDNLLKQMNSETKTQEILDALKLSTEDILTLKITHMASGLQDCLHSIVQAATHREVRAAVTRMSFYLLNDRLSLKGCPGPCGVTLKSLAWHTALNRFLQVLPACTEDEKLLIDIIHFLNKLIKEQRKNSSLELLNWILELLLRHSANPLLDLLVLTESQAREETDDIRTAVRQQLQKELIALFDTLLLNFMEVTDRKCSELLYVFQTQLALKLLQCLKVTDAPHFYGLPSLERTLRGMANLTAFPGWSSHSPLTKPLDICVKYLSGLLEVITSFYVERGGNAMSFMGKGVTKSTILCLLHLSHEMMAQAGSLEWMSLWFLPLGSHSEEHIPTQQGLAWLIPLWVDRDPEVRFTSLGLGSALTTLETGCVALANSCQNISGGLWGTVVNILLDQSECSMVRREAAFILQNLLVIPMPTEIIKDYTWQGPCVHDEDSGLSLIGKPALQALLYHCHFYEHLNQMVKHCYLGRCMFDLNFSAFDRNSESNDLNGLDDSFKFWRAPSRTSQDRDPSSLSTSETTVAPSLGSTEFQPLVQSTTLLPEASHDQFVAQGNRHFGTNIQF

SEQ ID NO: 15705 - protein, 879 aa, Homo sapiens
MVLAGLIRKLGHQLAEIRERALKSILCKIEHNLICYADLIQERQLFLHLLEWFNFPSVPMKEEVLNLLSRLVKYPPAVQHLVDVGAVEFLSKLRSNVEPNLQAEIDGILDGLFLLPSEVPALSSASYQTNQTELSKNPEILTGYFPQDKSNFQQMEVPPRPVVNQTVKCLKFSTFPWLPLTTTDRHVLSSNESSLRSSNHTLIWNTCELLKDVIMQDFPAEIFLQRPKIVQSLLSLLKLAFGDGKHRLALQSVSCLQQLCMYLRNRLNFHRDPGFFSNKHDTVSQNSSLSYCHEARGTHHSQNPSPGSSSPRPSVVGRTGQRPRGDGQDWDAASSSGSSSHAHVNSRISVHSPLDMGHIDLPELETEDTLELQFQQLSLPQFCVSILESAVPLLRTGSRQVIIRVLELLTEDMTLIGEAISTDIWDDSSLFGIDMKEKLLLVLGALGETMCYHKSSISLEQPEVMLVHHRMAFISISLFAVRLLQTLLPVEKASEFLSEPMSTALFLLSLDMPISLEYPNIHEAVVAYLEQLNSENYSIYKRTAEAVYSIECTCNFLSDIGKEGEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQGCRMFGTTMPHTLEEGFMW

SEQ ID NO: 15706 - protein, 145 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTNLLS

SEQ ID NO: 15707 - protein, 172 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHACDTWAVIL

SEQ ID NO: 15708 - protein, 219 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHSSELTEQKLRACLEGSINEHSAHCPHTPEFSVTGGTEEKSSLLMSCLACDTWAVIL

SEQ ID NO: 15709 - protein, 231 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHSSELTEQKLRACLEGSINEHSAHCPHTPEFSVTGGTEEKSSLLMSCLVSVSWDPLCGKRDLWLVLFPP

SEQ ID NO: 15710 - protein, 106 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQGL

SEQ ID NO: 15711 - protein, 148 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKPVILGL

SEQ ID NO: 15712 - protein, 106 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQVF

SEQ ID NO: 15713 - protein, 196 aa, Homo sapiens
MEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 15714 - protein, 232 aa, Homo sapiens
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERYDFHKLFHILGFLYSSLQIIIRSIYLQCGFILLFSPL

SEQ ID NO: 15715 - protein, 641 aa, Homo sapiens
MTFQVWGWRREDASQVLAWVPDAEGGRRGMLTRRSLATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 15716 - protein, 403 aa, Homo sapiens
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLNEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQSDNDLLTQTRTIAMSLVKCASSDTQDQYKLVKDISF

SEQ ID NO: 15717 - protein, 379 aa, Homo sapiens
MVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQSDNDLLTQTRTIAMSLVKCASSDTQDQYKLVKDISF

SEQ ID NO: 15718 - protein, 469 aa, Homo sapiens
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQSEKDLVKQAKTLNSAANKLIPKHH

SEQ ID NO: 15719 - protein, 506 aa, Homo sapiens
MAETPPPPTAGAESCSEEPARGGEWRPEEPRRAPAGGTDREGEAGPPPASPAGQSEPDSPVAAPFFLLYPGDGGAGFGVRPPPQQQRSWRTPPSPGSPLPFLLLSYPSGGGGSSGSGKHHPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQR

SEQ ID NO: 15720 - protein, 98 aa, Homo sapiens
MAETPPPPTAGAESCSEEPARGGEWRPEEPRRAPAGGTDREGEAGPPPASPAGQSEPDSPVAAPFFLLYPGDGGAGFGVRPPPQQQRSWRTPPSPGSP

SEQ ID NO: 15721 - protein, 453 aa, Homo sapiens
MDGEWLCLRELDDISLTPDPEPTHEDSWEDLTDLVEQMRDDTEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQSEKDLVKQAKTLNSAANKLIPKHH

SEQ ID NO: 15722 - protein, 620 aa, Homo sapiens
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQRLRQAERSRQSAELDNRLFKQDFGDKINSLQLEVEELTRQRNQLELELKQEKERRLQNDRSIPGRGSQKSESKMDGKHKMQEENVKLKKPLEESHRLQPHPMDEQDQLLLSEKPQLCQLCQEDGSLTKNVCKNCSGTFCDACSTNELPLPSSIKLERVCNPCHKHLMKQYSTSPS

SEQ ID NO: 15723 - protein, 571 aa, Homo sapiens
MAEEGAILKVTKDLRAAVSAILQGYGDGQGPVTDTSAELHRLCGCLELLLQFDQKEQKSFLGPRKDYWDFLCTALRRQRGNMEPIHFVRSQDKLKTPLGKGRAFIRFCLARGQLAEALQLCLLNSELTREWYGPRSPLLCPERQEDILDSLYALNGVAFELDLQQPDLDGAWPMFSESRCSSSTQTQGRRPRKNKDAPKKIPAAYGGPENVQIEDSHTSQAICLQDAPSGQQLAGLPRSQQQRHLPFFLEKKGESSRKHRYPQSMWEPEGKELQLDQEERAPWIEIFLGNSTPSTQGQGKGAMGTQKEVIGMEAEVTGVLLVAEGQRTTEGTHKKEAEWSHVQRLLMPSPRGAVEGAVSGSRQGSGGSSILGEPWVLQGHATKEDSTVENPQVQTEVTLVARREEQAEVSLQDEIKSLRLGLRKAEEQAQRQEQLLREQEGELQALREQLSRCQEERAELQAQLEQKQQEAERRDAMYQEELGGQRDLVQAMKRRVLELIQEKDRLWQRLQHLSSMAPECCVACSKIFGRFSRRYPCRLCGGLLCHACSMDYKKRDRCCPPCAQGREAQVT

SEQ ID NO: 15724 - protein, 607 aa, Homo sapiens
MAEEGAILKVTKDLRAAVSAILQGYGDGQGPVTDTSAELHRLCGCLELLLQFDQKEQKSFLGPRKDYWDFLCTALRRQRGNMEPIHFVRSQDKLKTPLGKGRAFIRFCLARGQLAEALQLCLLNSELTREWYGPRSPLLCPERQEDILDSLYALNGVAFELDLQQPDLDGAWPMFSESRCSSSTQTQGRRPRKNKDAPKKVPLPCLHSELPLPHLLGILKIPAAYGGPENVQIEDSHTSQAICLQDAPSGQQLAGLPRSQQQRHLPFFLEKKGESSRKHRYPQSMWEPEGKELQLDQEERAPWIEIFLGNSTPSTQGQGKGAMGTQKEVIGMEAEVTGVLLVAEGQRTTEGTHKKEAEWSHVQRLLMPSPRGAVEGAVSGSRQGSGGSSILGEPWVLQGHATKEDSTVENPQVQTEVTLVARREEQAEVSLQDEIKSLRLGLRKAEEQAQRQEQLLREQEGELQALREQLSRCQEERAELQAQLEQKQQEAERRDAMYQEELGGQRDLVQAMKRRVLELIQEKDRLWQRLQHLSSMAPECCVACSKIFGRFSRRYPCSARTSLGREESEPPGEAAMWRWRLWRGRASGHPSGEGRPPETNQGHSTGR

SEQ ID NO: 15725 - protein, 172 aa, Homo sapiens
MAEEGAILKVTKDLRAAVSAILQGYGDGQGPVTDTSAELHRLCGCLELLLQFDQKEQKSFLGPRKDYWDFLCTALRRQRGNMEPIHFVRSQDKGMVWTPEPSALPRTPRRHPGLSLCSQWGGLRVGPPAARPGWSLAHVLRVTLLQFHPNPGKETQKKQRCPKEDPSRIWRA

SEQ ID NO: 15726 - protein, 613 aa, Homo sapiens
MAAVEAAAEPVTVVAAVGPKAKDEEEEEEEPLPPCEAVRWAPVGAVAEARPGATAFLEEATAEEPGAAPGSPPDSPGRTLRRLRAERRRLDSALLALSSHFAQVQFRLRQVVRGAPAEQQRLLRELEDFAFRGCPHVLGYEGPGDPASDEGDGLPGDRPWLRGEDQSEQEKQERLETQREKQKELILQLKTQLDDLETFAYQEGSYDSLPQSVVLERQRVIIDELIKKLDMNLNEDISSLSTEELRQRVDAAVAQIVNPARVKEQLVEQLKTQIRDLEMFINFIQDEVGSPLQTGGGHCECKAGGKTGNGCSRTGSSRTPPGNSKTKAEDVKKVRETGLHLMRRALAVLQIFAVSQFGCATGQIPPTLWQRVQADRDYSPLLKRLEVSVDRVKQLALRQQPHDHVITSANLQDLSLGGKDELTMAVRKELTVAVRDLLAHGLYASSPGMSLVMAPIACLLPAFSSAPEAMHPWELFVKYYHAKNGRAYVESPARKLSQSFALPVTGGTVVTPKQSLLTAIHMVLTEHDPFKRSADSELKALVCMALNEQRLVSWVNLICKSGSLIEPHYQPWSYMAHTGFESALNLLSRLSSLKFSLPVDLAVRQLKNIKDAF

SEQ ID NO: 15727 - protein, 473 aa, Homo sapiens
MASRSLGGLSGIRGGGGGGGKKSLSARNAAVERRNLITVCRFSVKTLIDRSCFETIDDSSPEFNNFAAILEQILSHRLKEISQSCRWLAHLQIPLQGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQLTVLKNNDLRSRQELTAHLTNQWPSPGALDVNAVALDTLLYRKHNKQWYEKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 15728 - protein, 456 aa, Homo sapiens
MASRSLGGLSGIRGGGGGGGKKSLSARNAAVERRNLITVCRFSVKTLIDRSCFETIDDSSPEFNNFAAILEQILSHRLKGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQLTVLKNNDLRSRQELTAHLTNQWPSPGALDVNAVALDTLLYRKHNKQWYEKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 15729 - protein, 407 aa, Homo sapiens
MASRSLGGLSGIRGGGGGGGKKSLSARNAAVERRNLITVCRFSVKTLIDRSCFETIDDSSPEFNNFAAILEQILSHRLKGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQLKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 15730 - protein, 51 aa, Homo sapiens
MVMIFTLVTAVQEKLNEIVDQIKTRREEEKKQKEKEAEEAEKQLFHGTPVT

SEQ ID NO: 15731 - protein, 147 aa, Homo sapiens
MVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 15732 - protein, 243 aa, Homo sapiens
MTDYGEEQRNELEALESIYPDSFTVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 15733 - protein, 67 aa, Homo sapiens
MVMIFTLVTAVQEKLNEIVDQIKTRREEEKKQKEKEAEEAEKQLFHGTPVTIENFLNWKAKFDAELL

SEQ ID NO: 15734 - protein, 147 aa, Homo sapiens; identical to SEQ ID NO: 15731

SEQ ID NO: 15735 - protein, 72 aa, Homo sapiens
MVMIFTLVTAVQEKLNEIVDQIKTRREEEKKQKEKEAEEAEKQLFHGTPVTIENFLNWKAKFDAELLEIKKK

SEQ ID NO: 15736 - protein, 292 aa, Homo sapiens
MSASVKESLQLQLLEMEMLFSMFPNQGEVKLEDVNALTNIKRYLEGTREALPPKIEFVITLQIEEPKVKIDLQVTMPHSYPYVALQLFGRSSELDRHQQLLLNKGLTSYIGTFDPGELCVCAAIQWLQDNSASYFLNRKLVYEPSTQAKPVKNTFLRMWIYSHHIYQQDLRKKILDVGKRLDVTGFCMTGKPGIICVEGFKEHCEEFWHTIRYPNWKHISCKHAESVETEGNGEDLRLFHSFEELLLEAHGDYGLRNDYHMNLGQFLEFLKKHKSEHVFQILFGIESKSSDS

SEQ ID NO: 15737 - protein, 238 aa, Homo sapiens
MLWYLNLFDFHFKVKIDLQVTMPHSYPYVALQLFGRSSELDRHQQLLLNKGLTSYIGTFDPGELCVCAAIQWLQDNSASYFLNRKLVYEPSTQAKPVKNTFLRMWIYSHHIYQQDLRKKILDVGKRLDVTGFCMTGKPGIICVEGFKEHCEEFWHTIRYPNWKHISCKHAESVETEGNGEDLRLFHSFEELLLEAHGDYGLRNDYHMNLGQFLEFLKKHKSEHVFQILFGIESKSSDS

SEQ ID NO: 15738 - protein, 319 aa, Homo sapiens
MKIELSMQPWNPGYSSEGATAQETYTCPKMIEMEQAEAQLAELDLLASMFPGENELIVNDQLAVAELKDCIEKKTMEGRSSKVYFTINMNLDVSDEKMAMFSLACILPFKYPAVLPEITVRSVLLSRSQQTQLNTDLTAFLQKHCHGDVCILNATEWVREHASGYVSRDTSSSPTTGSTVQSVDLIFTRLWIYSHHIYNKCKRKNILEWAKELSLSGFSMPGKPGVVCVEGPQSACEEFWSRLRKLNWKRILIRHREDIPFDGTNDETERQRKFSIFEEKVFSVNGARGNHMDFGQLYQFLNTKGCGDVFQMFFGVEGQ

SEQ ID NO: 15739 - protein, 188 aa, Homo sapiens
MSANEDQEMELEALRSIYEGDESFRELSPVSFQYRIGENGDPKAFLIEISWTETYPQTPPILSMNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELPRGWNWVDVVKHLSKTGSKDDE

SEQ ID NO: 15740 - protein, 187 aa, Homo sapiens
MSANEDQEMELEALRSIYEGDESFRELSPVSFQYRIGENGDPKAFLIEISWTETYPQTPPILSMNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELPRGWNWVDVVKLSKTGSKDDE

SEQ ID NO: 15741 - protein, 995 aa, Homo sapiens
MSSLPRRAKVQVQDVVLKDEFSSFSELSSASEEDDKEDSAWEPQKKVPRSRKQPPPKESKPKRMPRVKKNAPQISDGSEVVVVKEELNSSVAIADTALEDRKNKLDTVQTLKTAKTKQKCAAQPHTVRRTKKLKVEEETSKASNLEGESNSSETPSTSTVWGGTCKKEENDDDFTFGQSALKKIKTETYPQGQPVKFPANANSTKEEVEMNWDMVQVLSERTNIEPWVCANIIRLFNDDNTIPFIIRYRKELINNLDADSLREVQQTLEELRAVAKKVHSTIQKIKKEGKMSECLLKAMLNCKTFEELEHVSAPYKTGSKGTKAQRARQLGLEGAARALLEKPGELSLLSYIRPDVKGLSTLQDIEIGVQHILADMIAKDKDTLDFIRNLCQKRHVCIQSSLAKVSSKKVNEKDVDKFLLYQHFSCNIRNIHHHQILAINRGENLKVLTVKVNISDGVKDEFCRWCIQNRWRPRSFARPELMKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 15742 - protein, 514 aa, Homo sapiens
MKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 15743 - protein, 101 aa, Homo sapiens
MNIPLGEKVMLDIVAMFRQYSGDDGRMDMPGLVNLMKENFPNFLSGCEKSDMDYLSNALEKKDDNKDKKVNYSEFLSLLGDITIDHHKIMHGVAPCSGGSQ

SEQ ID NO: 15744 - protein, 101 aa, Homo sapiens; identical to SEQ ID NO: 15743

SEQ ID NO: 15745 - protein, 112 aa, Homo sapiens
MLPSSGFLKAKMNIPLGEKVMLDIVAMFRQYSGDDGRMDMPGLVNLMKENFPNFLSGCEKSDMDYLSNALEKKDDNKDKKVNYSEFLSLLGDITIDHHKIMHGVAPCSGGSQ

SEQ ID NO: 15746 - protein, 904 aa, Homo sapiens
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHSTVTHNIREERMENGQPQPDNVLSTGPTGLINMAATPIPAMSARDLYATVTHNVCEQKMENVQPAPDNVLLTLRPRRINMTDTGISPMSTRDPYATITYNVPEEKMEKGQPQPDNILSTASTGLINVAGAGTPAISTNGLYSTVPHNVCEEKMENDQPQPNNVLSTVQPVIIYLTATGIPGMNTRDQYATITHNVCEERVVNNQPLPSNALSTVLPGLAYLATADMPAMSTRDQHATIIHNLREEKKDNSQPTPDNVLSAVTPELINLAGAGIPPMSTRDQYATVNHHVHEARMENGQRKQDNVLSNVLSGLINMAGASIPAMSSRDLYATITHSVREEKMESGKPQTDKVISNDAPQLGHMAAGGIPSMSTKDLYATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 15747 - protein, 904 aa, Homo sapiens; identical to SEQ ID NO: 15746

SEQ ID NO: 15748 - protein, 904 aa, Homo sapiens; identical to SEQ ID NO: 15746

SEQ ID NO: 15749 - protein, 528 aa, Homo sapiens
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 15750 - protein, 904 aa, Homo sapiens; identical to SEQ ID NO: 15746

SEQ ID NO: 15751 - protein, 74 aa, Homo sapiens [sequence omitted]

SEQ ID NO: 15752 - protein, 794 aa, Homo sapiens
MEAVSRVFPALAGQAPEEQGEIIKVKVKEEDHTWDQESALRRNLSYTRELSRQRFRQFCYQETPGPREALSQLRELCRQWLNPEIHTKEQILELLVLEQFLTILPEELQSWVREHNPESGEEVVTLLEDLERELDEPRQQVSQGTYGQEVSMEEMIPLDSAKESLGTQLQSMEDRMECESPEPHPLQDNGSFLWFSMMSQSMGGDNLSSLDTNEAEIEPENMREKFFRSLARLLENKSNNTKIFSKAKYCQLIKEVKEAKAKAKKESVDYRRLARFDVILVQGNEKLIEAVNGETDKIRYYLHSEDLFDILHNTHLSIGHGGRTRMEKELQAKYKNITKEVIMLYLTLCKPCQQKNSKLKKVLTSKSIKEVSSRCQVDLIDMQLNPDGEYRFILHYQDLCTKLTFLRSLKSKRPTEVAHALLDIFTIIGAPSVLQSDNGREFSSQVVSELSNIWPELKIVHGKSQTCQSQSSAEQTEDIRKRIFSWMQTNNSSHWTEFLWFIQMSQNQPYHRSMQQTPCESAFSSEAKLGLSHSQLTEELVASLHTENELDQADKELENTLRAQYEENIETGTDSSDIEENLSVTPKVAEKSPPESRLRFLSCVVCEKECTGVNSCISCDGNIHAICGVPSQHGTEGCGRQITCSLCYETSTMKRKHDEIQRSLPVKPSKMLKPSGTPFSPDKVGDWMAKQASLDFFVKKRHAFSEHSSSNKRNVNNRSYPEEGKTKRVHASFTRKYDPSYIEFGFVAVIDGEVLKPQCIICGDVLANEAMKPSKLKRHLYSKHKEISSQPKEF

SEQ ID NO: 15753 - protein, 578 aa, Homo sapiens
MNISVDLETNYAELVLDVGRVTLGENSRKKMKDCKLRKKQNESVSRAMCALLNSGGGVIKAEIENEDYSYTKDGIGLDLENSFSNILLFVPEYLDFMQNGNYFLIFVKSWSLNTSGLRITTLSSNLYKRDITSAKVMNATAALEFLKDMKKTRGRLYLRPELLAKRPCVDIQEENNMKALAGVFFDRTELDRKEKLTFTESTHVEIKNFSTEKLLQRIKEILPQYVSAFANTDGGYLFIGLNEDKEIIGFKAEMSDLDDLEREIEKSIRKMPVHHFCMEKKKINYSCKFLGVYDKGSLCGYVCALRVERFCCAVFAKEPDSWHVKDNRVMQLTRKEWIQFMVEAEPKFSSSYEEVISQINTSLPAPHSWPLLEWQRQRHHCPGLSGRITYTPENLCRKLFLQHEGLKQLICEEMDSVRKGSLIFSRSWSVDLGLQENHKVLCDALLISQDSPPVLYTFHMVQDEEFKGYSTQTALTLKQKLAKIGGYTKKVCVMTKIFYLSPEGMTSCQYDLRSQVIYPESYYFTRRKYLLKALFKALKRLKSLRDQFSFAENLYQIIGIDCFQKNDKKMFKSCRRLT

SEQ ID NO: 15754 - protein, 578 aa, Homo sapiens; identical to SEQ ID NO: 15753

SEQ ID NO: 15755 - protein, 15 aa, Homo sapiens
MNISVDLETNYAELV

SEQ ID NO: 15756 - protein, 69 aa, Homo sapiens
MNISVDLETNYAELVLDVGRVTLGENSRKKMKDCKLRKKQNESVSRAMCALLNSGGGVIKAEIENEDYS

SEQ ID NO: 15757 - protein, 128 aa, Homo sapiens
MNISVDLETNYAELVLDVGRVTLGENSRKKMKDCKLRKKQNESVSRAMCALLNSGGGVIKAEIENEDYSYTKDGIGLDLENSFSNILLFVPEYLDFMQNGNYFLIFVKSWSLNTSGLRITTLSSNLYK

SEQ ID NO: 15758 - protein, 578 aa, Homo sapiens; identical to SEQ ID NO: 15753

SEQ ID NO: 15759 - protein, 617 aa, Homo sapiens
MAMKIMEKIRNVFHCEAHRILYICESQFLRNFIRKEFLRGNGLAAGKMNISIDLDTNYAELVLNVGRVTLGENNRKKMKDCQLRKQQNENVSRAVCALLNSGGGVIKAEVENKGYSYKKDGIGLDLENSFSNMLPFVPNFLDFMQNGNYFHIFVKSWSLETSGPQIATLSSSLYKRDVTSAKVMNASAALEFLKDMEKTGGRAYLRPEFPAKRACVDVQEESNMEALAADFFNRTELGYKEKLTFTESTHVEIKNFSTEKLLQRITEILPQYVSAFANTDGGYLFVGLNEDKEVIGFKAEKSYLTKLEEVTKNSIGKLPVHHFCVEKGTINYLCKFLGVYDKGRLCGYVYALRVERFCCAVFAKKPDSWHVKDNRVKQLTEKEWIQFMVDSEPVCEELPSPASTSSPVSQSYPLREYINFKIQPLRYHLPGLSEKITCAPKTFCRNLFSQHEGLKQLICEEMGSVNKGSLIFSRSWSLDLGLQENHKVLCDALLISQDKPPVLYTFHMVQDEEFKDYSTQTAQTLKQKLAKIGGYTKKVCVMTKIFYLSPEGKTSCQYDLNSQVIYPESYYWTTAQTMKDLEKALSNILPKENQIFLFVCLFRFCLFVCWFVCFFLR

SEQ ID NO: 15760 - protein, 619 aa, Homo sapiens
MQLSEGLAAHTRRAGKWKRTQVPLLGEECADMDLARKEFLRGNGLAAGKMNISIDLDTNYAELVLNVGRVTLGENNRKKMKDCQLRKQQNENVSRAVCALLNSGGGVIKAEVENKGYSYKKDGIGLDLENSFSNMLPFVPNFLDFMQNGNYFHIFVKSWSLETSGPQIATLSSSLYKRDVTSAKVMNASAALEFLKDMEKTGGRAYLRPEFPAKRACVDVQEESNMEALAADFFNRTELGYKEKLTFTESTHVEIKNFSTEKLLQRITEILPQYVSAFANTDGGYLFVGLNEDKEVIGFKAEKSYLTKLEEVTKNSIGKLPVHHFCVEKGTINYLCKFLGVYDKGRLCGYVYALRVERFCCAVFAKKPDSWHVKDNRVKQLTEKEWIQFMVDSEPVCEELPSPASTSSPVSQSYPLREYINFKIQPLRYHLPGLSEKITCAPKTFCRNLFSQHEGLKQLICEEMGSVNKGSLIFSRSWSLDLGLQENHKVLCDALLISQDKPPVLYTFHMVQDEEFKDYSTQTAQTLKQKLAKIGGYTKKVCVMTKIFYLSPEGKTSCQYDLNSQVIYPESYYWTTAQTMKDLEKALSNILPKENQIFLFVCLFRFCLFVCWFVCFFLR

SEQ ID NO: 15761 - protein, 897 aa, Homo sapiens
MEANHCSLGVYPSYPDLVIDVGEVTLGEENRKKLQKTQRDQERARVIRAACALLNSGGGVIQMEMANRDERPTEMGLDLEESLRKLIQYPYLQAFFETKQHGRCFYIFVKSWSGDPFLKDGSFNSRICSLSSSLYCRSGTSVLHMNSRQAFDFLKTKERQSKYNLINEGSPPSKIMKAVYQNISESNPAYEVFQTDTIEYGEILSFPESPSIEFKQFSTKHIQQYVENIIPEYISAFANTEGGYLFIGVDDKSRKVLGCAKEQVDPDSLKNVIARAISKLPIVHFCSSKPRVEYSTKIVEVFCGKELYGYLCVIKVKAFCCVVFSEAPKSWMVREKYIRPLTTEEWVEKMMDADPEFPPDFAEAFESQLSLSDSPSLCRPVYSKKGLEHKADLQQHLFPVPPGHLECTPESLWKELSLQHEGLKELIHKQMRPFSQGIVILSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRETFLREKFEHIQHIVIDEAQNFRTEDGDWYRKAKTITQREKDCPGVLWIFLDYFQTSHLGHSGLPPLSAQYPREELTRVVRNADEIAEYIQQEMQLIIENPPINIPHGYLAILSEAKWVPGVPGNTKIIKNFTLEQIVTYVADTCRCFFERGYSPKDVAVLVSTVTEVEQYQSKLLKAMRKKMVVQLSDACDMLGVHIVLDSVRRFSGLERSIVFGIHPRTADPAILPNILICLASRAKQHLYIFL

SEQ ID NO: 15762 - protein, 579 aa, Homo sapiens
MEANHCSLAPKSWMVREKYIRPLTTEEWVEKMMDADPEFPPDFAEAFESQLSLSDSPSLCRPVYSKKGLEHKADLQQHLFPVPPGHLECTPESLWKELSLQHEGLKELIHKQMRPFSQGIVILSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRETFLREKFEHIQHIVIDEAQNFRTEDGDWYRKAKTITQREKDCPGVLWIFLDYFQTSHLGHSGLPPLSAQYPREELTRVVRNADEIAEYIQQEMQLIIENPPINIPHGYLAILSEAKWVPGVPGNTKIIKNFTLEQIVTYVADTCRCFFERGYSPKDVAVLVSTVTEVEQYQSKLLKAMRKKMVVQLSDACDMLGVHIVLDSVRRFSGLERSIVFGIHPRTADPAILPNILICLASRAKQHLYIFL

SEQ ID NO: 15763 - protein, 106 aa, Homo sapiens
MEANHCSLGVYPSYPDLVIDVGEVTLGEENRKKLQKTQRDQERARVIRAACALLNSGGGVIQMEMANRDERPTEMGLDLEESLRKLIQYPYLQAFFETKQHGRCFY

SEQ ID NO: 15764 - protein, 897 aa, Homo sapiens; identical to SEQ ID NO: 15761

SEQ ID NO: 15765 - protein, 579 aa, Homo sapiens; identical to SEQ ID NO: 15762

SEQ ID NO: 15766 - protein, 897 aa, Homo sapiens; identical to SEQ ID NO: 15761

SEQ ID NO: 15767 - protein, 912 aa, Homo sapiens
MESLKTDTEMPYPEVIVDVGRVIFGEENRKKMTNSCLKRSENSRIIRAICALLNSGGGVIKAEIDDKTYSYQCHGLGQDLETSFQKLLPSGSQKYLDYMQQGHNLLIFVKSWSPDVFSLPLRICSLRSNLYRRDVTSAINLSASSALELLREKGFRAQRGRPRVKKLHPQQVLNRCIQEEEDMRILASEFFKKDKLMYKEKLNFTESTHVEFKRFTTKKVIPRIKEMLPHYVSAFANTQGGYVLIGVDDKSKEVVGCKWEKVNPDLLKKEIENCIEKLPTFHFCCEKPKVNFTTKILNVYQKDVLDGYVCVIQVEPFCCVVFAEAPDSWIMKDNSVTRLTAEQWVVMMLDTQSAPPSLVTDYNSCLISSASSARKSPGYPIKVHKFKEALQRHLFPVTQEEVQFKPESLCKKLFSDHKELEGLMKTLIHPCSQGIVIFSRSWAGDVGFRKEQNVLCDALLIAVNSPVVLYTILIDPNWPGGLEYARNTAHQLKQKLQTVGGYTGKVCIIPRLIHLSSTQSRPGEIPLRYPRSYRLADEEEMEDLLQALVVVSLSSRSLLSDQMGCEFFNLLIMEQSQLLSESLQKTRELFIYCFPGVRKTALAIKIMEKIKDLFHCKPKEILYVCESDSLKDFVTQQTTCQAVTRKTFMQGEFLKIKHIVMDETENFCSKYGNWYMKAKNITHPKAKGTGSENLHHGILWLFLDPFQIHHADVNGLPPPSAQFPRKTITSGIHCALEIAKVMKEEMKRIKENPPSNMSPDTLALFSETAYEEATCAQALPGVCETKTNLTTEQIANYVARKCHSLFQCGYLPKDIAILCRRGEDRGRYRLALLKAMELIETHRPSEVVFSPATGVWGSHIVLDSIQQFSGLERTVVFGLSPECDQSEEFHKLCFASRAIKHLYLLYEKRAAY

SEQ ID NO: 15768 - protein, 891 aa, Homo sapiens
MSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKEKIDLTSLRASIDGCIKKLPVHHFCTQRPEIKYVLNFLEVHDKGALRGYVCAIKVEKFCCAVFAKVPSSWQVKDNRVRQLPTREWTAWMMEADPDLSRCPEMVLQLSLSSATPRSKPVCIHKNSECLKEQQKRYFPVFSDRVVYTPESLYKELFSQHKGLRDLINTEMRPFSQGILIFSQSWAVDLGLQEKQGVICDALLISQNNTPILYTIFSKWDAGCKGYSMIVAYSLKQKLVNKGGYTGRLCITPLVCVLNSDRKAQSVYSSYLQIYPESYNFMTPQHMEALLQSLVIVLLGFKSFLSEELGSEVLNLLTNKQYELLSKNLRKTRELFVHGLPGSGKTILALRIMEKIRNVFHCEPANILYICENQPLKKLVSFSKKNICQPVTRKTFMKNNFEHIQHIIIDDAQNFRTEDGDWYGKAKFITQTARDGPGVLWIFLDYFQTYHLSCSGLPPPSDQYPREEINRVVRNAGPIANYLQQVMQEARQNPPPNLPPGSLVMLYEPKWAQGVPGNLEIIEDLNLEEILIYVANKCRFLLRNGYSPKDIAVLFTKASEVEKYKDRLLTAMRKRKLSQLHEESDLLLQIGDASDVLTDHIVLDSVCRFSGLERNIVFGINPGVAPPAGAYNLLLCLASRAKRHLYILKASV

SEQ ID NO: 15769 - protein, 389 aa, Homo sapiens
MSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKEKIDLTSLRASIDGCIKKLPVHHFCTQRPEIKYVLNFLEVHDKGALRGYVCAIKVEKFCCAVFAKVPSSWQVKDNRVRQLPTREWTAWMMEADPDLSRCPEMVLQLSLSSATPRSKPVCIHKNSECLKEQQKRYFPVSARKTSASQ

SEQ ID NO: 15770 - protein, 407 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQRWLVELGKLEEKMKALMMEKEQLQQQLQQHGPVSCTCCVL

SEQ ID NO: 15771 - protein, 407 aa, Homo sapiens; identical to SEQ ID NO: 15770

SEQ ID NO: 15772 - protein, 348 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQRWLVELGKLEEKMKALMMEKEQLQQQLQQHGPVSCTCCVL

SEQ ID NO: 15773 - protein, 359 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKRWLVELGKLEEKMKALMMEKEQLQQQLQQHGPVSCTCCVL

SEQ ID NO: 15774 - protein, 359 aa, Homo sapiens; identical to SEQ ID NO: 15773

SEQ ID NO: 15775 - protein, 407 aa, Homo sapiens; identical to SEQ ID NO: 15770

SEQ ID NO: 15776 - protein, 639 aa, Homo sapiens
MSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITDWDSSINLTFHKSKIAVDELFTSLRDIAGARSLLKQFKSVYVPGNHTHQVSRPHPSDYPLLILFVVGGVTVSEVKMVKDLVASLKPGTQVIVLSTRLLKPLNIPELLFATDRLHPDLGF

SEQ ID NO: 15777 - protein, 684 aa, Homo sapiens
MSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITDWDSSINLTFHKSKIAVDELFTSLRDIAGARSLLKQFKSVYVPGNHTHQASYKPLLKQVVEEIFHPERPDSVDIEHMSSGLTDLLKTGFSMFMKVSRPHPSDYPLLILFVVGGVTVSEVKMVKDLVASLKPGTQVIVLSTRLLKPLNIPELLFATDRLHPDLGF

SEQ ID NO: 15778 - protein, 258 aa, Homo sapiens
MQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPASPYVVDHGESGPLRCNRCKAYMCPFMQFIEGGRRFQCCFCSCINDGRVGQKSQQSALALSPTIRCSTSIM

SEQ ID NO: 15779 - protein, 425 aa, Homo sapiens
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGMGVAQAPQVLSPTFGAQDPVRTLPRFQTQVDRRHTLYRGHQAALGLMERDQDRGQQLQQKQQDLEQEGLEATQGLLAGEWAPPLWELGSLFQAFVKRESQAYA

SEQ ID NO: 15780 - protein, 378 aa, Homo sapiens
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGMGVAQAPQVLSPTFGAQDPVRTLPRFQTQVDRRHTLYRGHQAALGLMERDQVSPRE

SEQ ID NO: 15781 - protein, 424 aa, Homo sapiens
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 15782 - protein, 113 aa, Homo sapiens
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLV

SEQ ID NO: 15783 - protein, 135 aa, Homo sapiens
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLE

SEQ ID NO: 15784 - protein, 10 aa, Homo sapiens
MEPFSCDTFV

SEQ ID NO: 15785 - protein, 216 aa, Homo sapiens
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGK

SEQ ID NO: 15786 - protein, 209 aa, Homo sapiens
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKR

SEQ ID NO: 15787 - protein, 417 aa, Homo sapiens
MPPLATPPSVHLSLRVAGRPDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 15788 - protein, 1056 aa, Homo sapiens
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISEVNEKEYETNWRNMVETSDGLEASENEKEVSCKHSTSEKPSKLPFDTPPIGKQPSLVATGSTTSATSAGKSTASDKEEVKPDDLEWASQQSTETGSLDGSCRDLLNSSITSTTSTLVPGMLEEEEDEDEEEEEDYTHEPISVEVQLNSRIESWVSETQRTMETLQLGKTLNGSEEDNVEQSGEEEAEAPEVLEPGMDSEAWTADQQASPGQQKSSNCSSLNKEHSDSNYTTQTT

SEQ ID NO: 15789 - protein, 1101 aa, Homo sapiens
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQVGFRCRGHSTSSERRQNLQKRPDNKHLSSSQSHRSDPNSESLYFEDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISEVNEKEYETNWRNMVETSDGLEASENEKEVSCKHSTSEKPSKLPFDTPPIGKQPSLVATGSTTSATSAGKSTASDKEEVKPDDLEWASQQSTETGSLDGSCRDLLNSSITSTTSTLVPGMLEEEEDEDEEEEEDYTHEPISVEVQLNSRIESWVSETQRTMETLQLGKTLNGSEEDNVEQSGEEEAEAPEVLEPGMDSEAWTADQQASPGQQKSSNCSSLNKEHSDSNYTTQTT

SEQ ID NO: 15790 - protein, 95 aa, Homo sapiens
MKGSRALLLVALTLFCICRMATGEDNDEFFMDFLQTLLVGTPEELYEGTLGKYNVNEDAKAAMTELKSCRDGLQPMHKAELVKLLVQVLGSQDGA

SEQ ID NO: 15791 - protein, 180 aa, Homo sapiens
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQRQGFTMLARLPSNF

SEQ ID NO: 15792 - protein, 168 aa, Homo sapiens
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQMI

SEQ ID NO: 15793 - protein, 2533 aa, Homo sapiens
MVLELPIQNEPPGQAAAEEKHTCVVQYILFPPHSTSTKDSFSTDDDNDVEVEALEGDSELNLVTEVWVEPQYGRVGPGPGIWKHLQDLTYSEIPQALHPRDAACIGSMLSFEYLIQLCQSKEWGPLPPEPRVSDGLDQGGDTCVHEIPFHFDLMGLLPQCQQLQMFFLLLARGAEGPLLGVHGIPKEQAVGSTQATGDSAFTSLSVGLPETLKPLISAQPPQWRCYARLVNPQHVFLTFLPATFSDVQRLAACGLEGPPQEETKPKFGDWSGAPSLKDLGGTGIKATKSHVPVLSVTLASDNAQNQGELSPPFRRDLQAYAGRQASQTESADGPRTRCPVYIYSCSLEALREQMVGMQPPQAPRDLIFRTQFLDHPSPSSAWMEPRYKEAANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQVLSSLEGPPVGGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 15794 - protein, 178 aa, Homo sapiens
MASERPEPEVEEAGQVFLLMKKDYRISRNVRLAWFLSHLHQTVQATPQEMLSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQRQGFTMLARLPSNF

SEQ ID NO: 15795 - protein, 3375 aa, Homo sapiens
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQVLVQGCLLDPSQREVFLQQIYEQLCLFEDKVATMLQQQYDPQSQAEDQSPDSGDLLGRKVGVSMVTADLGLVSMIRQGILALQLLPSNSSAGIIVITDGVTSVPDVAVCETLLNQLRSGTVACSFVQVGGVYSYDCSFGHVPNVELMKFIAMATFGSYLSTCPEPEPGNLGLTVYHRAFLLYSFLRSGEALNPEYYCGSQHRLFNEHLVSASSNPALALRRKKHTEKEVPADLVSTVSVRLREGYSVREVTLAKGGSQLEVKLVLLWKHNMRIEYVAMAPWPLEPEGPRVTRVEVTMEGGYDILHDVSCALRQPIRSLYRTHVIRRFWNTLQSINQTDQMLAHLQSFSSVPEHFTLPDSTKSGVPLFYIPPGSTTPVLSLQPSGSDSSHAQFAAYWKPVLSMDANSWQRWLHMHRLVLILEHDTPIPKHLHTPGSNGRYSTIQCRISHSSLTSLLRDWSSFVLVEGYSYVKLLSSAPDQPPNSFYMVRIISKAPCMVLRLGFPIGTPAPARHKIVSGLREEILRLRFPHRVQSKEPTPKVKRKGLGGAGGGSSPSKSPPVLGPQQALSDRPCLVVLHKPLDKLLIRYEKLPLDYRAPFLLTLEPPGPLPLVSGRSASSSLASLSRYLYHQRWLWSVPSGLAPALPLSAIAQLLSILTEVRLSEGFHFACSGEGIINMVLELPIQNEPPGQAAAEEKHTCVVQYILFPPHSTSTKDSFSTDDDNDVEVEALEGDSELNLVTEVWVEPQYGRVGPGPGIWKHLQDLTYSEIPQALHPRDAACIGSMLSFEYLIQLCQSKEWGPLPPEPRVSDGLDQGGDTCVHEIPFHFDLMGLLPQCQQLQMFFLLLARGAEGPLLGVHGIPKEQAVGSTQATGDSAFTSLSVGLPETLKPLISAQPPQWRCYARLVNPQHVFLTFLPATFSDVQRLAACGLEGPPQEETKPKFGDWSGAPSLKDLGGTGIKATKSHVPVLSVTLASDNAQNQGELSPPFRRDLQAYAGRQASQTESADGPRTRCPVYIYSCSLEALREQMVGMQPPQAPRDLIFRTQFLDHPSPSSAWMEPRYKEAANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQVLSSLEGPPVGGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 15796 - protein, 231 aa, Homo sapiens
MAGMVDFQDEEQVKSFLENMEVECNYHCYHEKDPDGCYRLVDYLEGIRKNFDEAAKVLKFNCEENQHSDSCYKLGAYYVTGKGGLTQDLKAAARCFLMACEKPGKKSIAACHNVGLLAHDGQVNEDGQPDLGKARDYYTRACDGGYTSSCFNLSAMFLQGAPGFPKDMDLACKYSMKACDLGHIWACANASRMYKLGDGVDKDEAKAEVLKNRAQQLHKEQQKGVQPLTFG

SEQ ID NO: 15797 - protein, 94 aa, Homo sapiens
  MOD_RES (92)..(92): Selenocysteine
MVYISNGQVLDSRSQSPWRLSLITDFFWGIAEFVVLFFKTLLQQDVKKRRSYGNSSDSRYDDGRGPPGNPPRRMGRINHLRGPSPPPMAGGCGR

SEQ ID NO: 15798 - protein, 91 aa, Homo sapiens
MVYISNGQVLDSRSQSPWRLSLITDFFWGIAEFVVLFFKTLLQQDVKKRRSYGNSSDSRYDDGRGPPGNPPRRMGRINHLRGPSPPPMAGG

SEQ ID NO: 15799 - protein, 145 aa, Homo sapiens
  MOD_RES (48)..(48): Selenocysteine
MSLLLPPLALLLLLAALVAPATAATAYRPDWNRLSGLTRARVETCGGCQLNRLKEVKAFVTQDIPFYHNLVMKHLPGADPELVLLGRRYEELERIPLSEMTREEINALVQELGFYRKAAPDAQVPPEYVWAPAKPPEETSDHADL

SEQ ID NO: 15800 - protein, 145 aa, Homo sapiens; identical to SEQ ID NO: 15799
  MOD_RES (48)..(48): Selenocysteine

SEQ ID NO: 15801 - protein, 669 aa, Homo sapiens
  MOD_RES (667)..(667): Selenocysteine
MAVYRAALGASLAAARLLPLGRCSPSPAPRSTLSGAAMEPAPRWLAGLRFDNRALRALPVEAPPPGPEGAPSAPRPVPGACFTRVQPTPLRQPRLVALSEPALALLGLGAPPAREAEAEAALFFSGNALLPGAEPAAHCYCGHQFGQFAGQLGDGAAMYLGEVCTATGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVTCSS

SEQ ID NO: 15802 - protein, 195 aa, Homo sapiens
  MOD_RES (49)..(49): Selenocysteine
MRLLLLLLVAASAMVRSEASANLGGVPSKRLKMQYATGPLLKFQICVSCGYRRVFEEYMRVISQRYPDIRIEGENYLPQPIYRHIASFLSVFKLVLIGLIIVGKDPFAFFGMQAPSIWQWGQENKVYACMMVFFLSNMIENQCMSTGAFEITLNDVPVWSKLESGHLPSMQQLVQILDNEMKLNVHMDSIPHHRS

SEQ ID NO: 15803 - protein, 346 aa, Homo sapiens
  MOD_RES (273)..(273): Selenocysteine
MNNQARTPAPSSARTSTSVRASTPTRTPTPLRTPTPVRTRTPIRTLTPVLTPSPAGTSPLVLTPAPAQIPTLVPTPALARIPRLVPPPAPAWIPTPVPTPVPVRNPTPVPTPARTLTPPVRVPAPAPAQLLAGIRAALPVLDSYLAPALPLDPPPEPAPELPLLPEEDPEPAPSLKLIPSVSSEAGPAPGPLPTRTPLAANSPGPTLDFTFRADPSAIGLADPPIPSPVPSPILGTIPSAISLQNCTETFPSSSENFALDKRVLIRVTYCGLCSYSLRYILLKKSLEQQFPNHLLFEEDRAAQATGEFEVFVNGRLVHSKKRGDGFVNESRLQKIVSVIDEEIKKR

SEQ ID NO: 15804 - protein, 346 aa, Homo sapiens
MNNQARTPAPSSARTSTSVRASTPTRTPTPLRTPTPVRTRTPIRTLTPVLTPSPAGTSPLVLTPAPAQIPTLVPTPALARIPRLVPPPAPAWIPTPVPTPVPVRNPTPVPTPARTLTPPVRVPAPAPAQLLAGIRAALPVLDSYLAPALPLDPPPEPAPELPLLPEEDPEPAPSLKLIPSVSSEAGPAPGPLPTRTPLAANSPGPTLDFTFRADPSAIGLADPPIPSPVPSPILGTIPSAISLQNCTETFPSSSENFALDKRVLIRVTYCFIHSYSLRYILLKKSLEQQFPNHLLFEEDRAAQATGEFEVFVNGRLVHSKKRGDGFVNESRLQKIVSVIDEEIKKR

SEQ ID NO: 15805 - protein, 749 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 15806 - protein, 147 aa, Homo sapiens
MGGCMHSTQDKSLHLEGDPNPSAAPTSTCAPRKMPKRISISKQLASVKALRKCSDLEKAIATTALIFRNSSDSDGKLEKAIAKDLLQTQFRNFAEGQETKPKYREILSELDEHTENKLDFEDFMILLLSITVMSDLLQNIRNVKIMK

SEQ ID NO: 15807 - protein, 92 aa, Homo sapiens
MEQSKVLIKEGGVQLLLTIVDTPGFGDAVDNSNCWQPAINYIDSKFEDYLNAESRVNRCQMPGNRVQCCLYFIAPSGHGWQTRNMDYCVEFH

SEQ ID NO: 15808 - protein, 92 aa, Homo sapiens; identical to SEQ ID NO: 15807

SEQ ID NO: 15809 - protein, 422 aa, Homo sapiens
MEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 15810 - protein, 422 aa, Homo sapiens; identical to SEQ ID NO: 15809

SEQ ID NO: 15811 - protein, 335 aa, Homo sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 15812 - protein, 568 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 15813 - protein, 455 aa, Homo sapiens
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 15814 - protein, 97 aa, Homo sapiens
MKGICSDAILVLATSMWMAFAIDFPLPMASERGQLDKTIVECLKNVNKCWFLSYIKPSEPICGSDQVTYSSDCHLCSKILFEGLNITKLYDGQCENS

SEQ ID NO: 15815 - protein, 597 aa, Homo sapiens
MSSTVNNGAASMQSTPDAANGFPQPSSSSGTWPRAEEELRAAEPGLVKRAHREILDHERKRRVELKCMELQEMMEEQGYSEEEIRQKVGTFRQMLMEKEGVLTREDRPGGHIVAETPRLTEGAEPGLEYAPFDDDDGPVDCDCPASCYRGHRGYRTKHWSSSSASPPPKKKKKKKGGHRRSRKKRRLESECSCGSSSPLRKKKKSVKKHRRDRSDSGSRRKRRHRSRSSKCKRKEKNKEKKRPHTESPGRRSHRHSSGSSHSPSLSSHYSDSRSPSRLSPKHRDEGRKTGSQRSSGSRSPSPSGGSGWGSPQRNGGSGQRSGAHGGRPGSAHSPPDKPSSPSPRVRDKAAAAAPTPPARGKESPSPRSAPSSQGRGGRAAGGAGRRRRRRRRRRRSRSSASAPRRRGRRRPRPAPPRGSSRSLSRARSSSDSGSGRGAPGPGPEPGSERGHGGHGKRAKERPPRARPASTSPSPGAHGRRGGPEGKSSSRSPGPHPRSWSSSRSPSKSRSRSAEKRPHSPSRSPSPKKPLSRDKDGEGRARHSEAEATRARRRSRSYSPIRKRRRDSPSFMEPRRITSAASVLFHTTGPAPLPPPAA

SEQ ID NO: 15816 - protein, 653 aa, Homo sapiens
MSSTVNNGAASMQSTPDAANGFPQPSSSSGTWPRAEEELRAAEPGLVKRAHREILDHERKRRVELKCMELQEMMEEQGYSEEEIRQKVGTFRQMLMEKEGVLTREDRPGGHIVAETPRLTEGAEPGLEYAPFDDDDGPVDCDCPASCYRGHRGYRTKHWSSSSASPPPKKKKKKKGGHRRSRKKRRLESECSCGSSSPLRKKKKSVKKHRRDRSDSGSRRKRRHRSRSSKCKRKEKNKEKKRPHTESPGRRSHRHSSGSSHSPSLSSHYSDSRSPSRLSPKHRDEGRKTGSQRSSGSRSPSPSGGSGWGSPQRNGGSGQRSGAHGGRPGSAHSPPDKPSSPSPRVRDKAAAAAPTPPARGKESPSPRSAPSSQGRGGRAAGGAGRRRRRRRRRRRSRSSASAPRRRGRRRPRPAPPRGSSRSLSRARSSSDSGSGRGAPGPGPEPGSERGHGGHGKRAKERPPRARPASTSPSPGAHGRRGGPEGKSSSRSPGPHPRSWSSSRSPSKSRSRSAEKRPHSPSRSPSPKKPLSRDKDGEGRARHSEAEATRARRRSRSYSPIRKRRRDSPSFMEPRRITRRRKRPIPYYRPSPSSSSSCLSSDYSTRSHSRSPSPGHSHGSYSSRSHGTRSRTRSPSRTPSPSYHSRSSSESGGF

SEQ ID NO: 15817 - protein, 597 aa, Homo sapiens; identical to SEQ ID NO: 15815

SEQ ID NO: 15818 - protein, 653 aa, Homo sapiens; identical to SEQ ID NO: 15816

SEQ ID NO: 15819 - protein, 715 aa, Homo sapiens
MSSPKRSSKPSMSLAPSGSSMPTADPKPPASLKSTKSATPNRSLVPTKPATSRNSVMSPSSSKSTKSTSTKRAPSNRPSSRSRVRSKARTPSRVSTDTRTSKASKASDVRCHQRRGTHSRGRTPGRRGSRSSKRSPSRASTPGRIRTHGARPGMASRVRTPTSQQKGSRGKSYGRPRTSNRERSDSQPRNLSKKSYRPPGGSGIGRSSELAVTPSTAKCQTPTGIPSKEKSDNPSPSSSRKVKSYGQMIIPSREKSYSPTEMSSRVKSYNQASTRSRPQSHSQSRSPRRSRSGSQKRTHSRVRSHSWKRNHSRARSRTRKGILSQMGRHSQSRSHSKGKSQNQSRTPRRGRSHNWSRNPSKERSHSHSRSSSKERDHRGSSSPRKESGRSQSGSPNKQRDHSRSRSPNKARDRSRSRSPYKARDRSRSRSPNKARDCSRSRSPYKARDRSRSRSPNKARDHSRSRSPNKARDRSRSRSPSKERDHSQLGSPSKERDHRRSRSPSKERQCRQSRSSSKERDHRRSRSPSKERQRRQSRSPNKERDRSQSRSPSEEREHRQSRSPSKERDRRRWRSPSKERERRQSRSSSEERDHSRSRSPNKQSGYSRPRASSKEKAHSRSRTPSKEGNHSQSRTSSKESDPSQSTVPRSPDWKRSPTRTSSLSQNRTPSKTSSHSPSTFPSGGQTLSQDDSQADATTSKATLPGERSSSSSSKLA

SEQ ID NO: 15820 - protein, 730 aa, Homo sapiens
MSTVTSRTTSPFAPTMSSPKRSSKPSMSLAPSGSSMPTADPKPPASLKSTKSATPNRSLVPTKPATSRNSVMSPSSSKSTKSTSTKRAPSNRPSSRSRVRSKARTPSRVSTDTRTSKASKASDVRCHQRRGTHSRGRTPGRRGSRSSKRSPSRASTPGRIRTHGARPGMASRVRTPTSQQKGSRGKSYGRPRTSNRERSDSQPRNLSKKSYRPPGGSGIGRSSELAVTPSTAKCQTPTGIPSKEKSDNPSPSSSRKVKSYGQMIIPSREKSYSPTEMSSRVKSYNQASTRSRPQSHSQSRSPRRSRSGSQKRTHSRVRSHSWKRNHSRARSRTRKGILSQMGRHSQSRSHSKGKSQNQSRTPRRGRSHNWSRNPSKERSHSHSRSSSKERDHRGSSSPRKESGRSQSGSPNKQRDHSRSRSPNKARDRSRSRSPYKARDRSRSRSPNKARDCSRSRSPYKARDRSRSRSPNKARDHSRSRSPNKARDRSRSRSPSKERDHSQLGSPSKERDHRRSRSPSKERQCRQSRSSSKERDHRRSRSPSKERQRRQSRSPNKERDRSQSRSPSEEREHRQSRSPSKERDRRRWRSPSKERERRQSRSSSEERDHSRSRSPNKQSGYSRPRASSKEKAHSRSRTPSKEGNHSQSRTSSKESDPSQSTVPRSPDWKRSPTRTSSLSQNRTPSKTSSHSPSTFPSGGQTLSQDDSQADATTSKATLPGERSSSSSSKLA

SEQ ID NO: 15821 - protein, 396 aa, Homo sapiens
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHGHVHITDFNIAAMLPRETQITTMAGTKPYMAPEMFSSRKGAGYSFAVDWWSLGVTAYELLRGRRPYHIRSSTSSKEIVHTFETTVVTYPSAWSQEMVSLLKKLLEPNPDQRFSQLSDVQNFPYMNDINWDAVFQKRLIPGFIPNKGRLNCDPTFELEEMILESKPLHKKKKRLAKKEKDMRKCDSSQTCLLQEHLDSVQKEFIIFNREKVNRDFNKRQPNLALEQTKDPQGEDGQNNNL

SEQ ID NO: 15822 - protein, 166 aa, Homo sapiens
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHVQQYTLKSH

SEQ ID NO: 15823 - protein, 166 aa, Homo sapiens
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHDTWLSYKSH

SEQ ID NO: 15824 - protein, 414 aa, Homo sapiens
MGGNHSHKPPVFDENEEVNFDHFQILRAIGKGSFGKVCIVQKRDTKKMYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 15825 - protein, 367 aa, Homo sapiens
MYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 15826 - protein, 486 aa, Homo sapiens
MRSGAERRGSSAAASPGSPPPGRARPAGSDAPSALPPPAAGQPRARDSGDVRSQPRPLFQWSKWKKRMGSSMSAATARRPVFDDKEDVNFDHFQILRAIGKGSFGKVCIVQKRDTEKMYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPICPSAGSG

SEQ ID NO: 15827 - protein, 178 aa, Homo sapiens
  MOD_RES (1)..(1): Any amino acid
XGLEGVVVDGQVETARVWRGDRPGTEGKEESGMLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRSLLRAHPRTGILPGRCGMVWKDKKLQPSGCHEKAGGVFCGPSRGGV

SEQ ID NO: 15828 - protein, 277 aa, Homo sapiens
PFFRARGLEGVVVDGQVETARVWRGDRPGTEGKEESGMLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRMNFDHFQILRAIGKGSFGKVSPRVPRRPQASCRTALCPPGVHCAEAGHGEDVRHEVHEQAAVHRARRGPQRLPGAGDPAGDRARLPGEPLVLLPGRGGHVHGRGPATGRGPALPPAAERAVLRGHGEAVHLRDGTGSGLP

SEQ ID NO: 15829 - protein, 369 aa, Homo sapiens
MYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPICPSAGSG

SEQ ID NO: 15830 - protein, 499 aa, Homo sapiens
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRMNFDHFQILRAIGKGSFGKVCIVQKRDTEKMYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPICPSAGSG

SEQ ID NO: 15831 - protein, 136 aa, Homo sapiens
  MOD_RES (1)..(1): Any amino acid
XARGLEGVVVDGQVETARVWRGDRPGTEGKEESGMLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRRS

SEQ ID NO: 15832 - protein, 313 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQRSWAYVKKCKNNMCPNRGLVSQLLEWEKTILGDSITNIMDPLY

SEQ ID NO: 15833 - protein, 217 aa, Homo sapiens
MPGLLLCEPTELYNILNQATKLSRLTDPNYLCLLDVRSKWEYDESHVITALRVKKELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQRSWAYVKKCKNNMCPNRGLVSQLLEWEKTILGDSITNIMDPLY

SEQ ID NO: 15834 - protein, 313 aa, Homo sapiens; identical to SEQ ID NO: 15832

SEQ ID NO: 15835 - protein, 112 aa, Homo sapiens [sequence omitted]

SEQ ID NO: 15836 - protein, 318 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEVLGLCQEVQKQHVSKSGIGEPAAGMGEDYPWRFHHKHHGSALLIFSEAHRRVLKSLTWGHFVGGGPECVYPGLSGRRRPLLPESL

SEQ ID NO: 15837 - protein, 313 aa, Homo sapiens; identical to SEQ ID NO: 15832

SEQ ID NO: 15838 - protein, 313 aa, Homo sapiens; identical to SEQ ID NO: 15832

SEQ ID NO: 15839 - protein, 436 aa, Homo sapiens
MTAVYMNGGGLVNPHYARWDRRDSVESGCQTESSKEGEEGQPRQLTPFEKLTQDMSQDEKVVREITLGKRIGFYRIRGEIGSGNFSQVKLGIHSLTKEKVAIKILDKTKLDQKTQRLLSREISSMEKLHHPNIIRLYEVVETLSKLHLVMEYAGGGELFGKISTEGKLSEPESKLIFSQIVSAVKHMHENQIIHRDLKAENVFYTSNTCVKVGDFGFSTVSKKGEMLNTFCGSPPYAAPELFRDEHYIGIYVDIWALGVLLYFMVTGTMPFRAETVAKLKKSILEGTYSVPPHVSEPCHRLIRGVLQQIPTERYGIDCIMNDEWMQGVPYPTPLEPFQLDPKHLSETSTLKEEENEVKSTLEHLGITEEHIRNNQGRDARSSITGVYRIILHRVQRKKALESVPVMMLPDPKERDLKKGSRVYRGIRHTSKFCSIL

SEQ ID NO: 15840 - protein, 436 aa, Homo sapiens; identical to SEQ ID NO: 15839

SEQ ID NO: 15841 - protein, 379 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 15842 - protein, 228 aa, Homo sapiens
MVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 15843 - protein, 341 aa, Homo sapiens
MAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 15844 - protein, 217 aa, Homo sapiens
MVLVNAIYFKGQWQNKFQVRETVKSPFQLSEGKNVTVEMMYQIGTFKLAFVKEPQMQVLELPYVNNKLSMIILLPVGIANLKQIEKQLNSGTFHEWTSSSNMMEREVEVHLPRFKLETKYELNSLLKSLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 15845 - protein, 190 aa, Homo sapiens
MGSLSTANVEFCLDVFKELNSNNIGDNIFFSSLSLLYALSMVLLGARGETEEQLEKIEKQLNSGTFHEWTSSSNMMEREVEVHLPRFKLETKYELNSLLKSLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 15846 - protein, 392 aa, Homo sapiens
MGSLSTANVEFCLDVFKELNSNNIGDNIFFSSLSLLYALSMVLLGARGETEEQLEKVLHFSHTVDSLKPGFKDSPKCSQAGRIHSEFGVEFSQINQPDSNCTLSIANRLYGTKTMAFHQQYLSCSEKWYQARLQTVDFEQSTEETRKTINAWVENKTNGKVANLFGKSTIDPSSVMVLVNAIYFKGQWQNKFQVRETVKSPFQLSEGKNVTVEMMYQIGTFKLAFVKEPQMQVLELPYVNNKLSMIILLPVGIANLKQIEKQLNSGTFHEWTSSSNMMEREVEVHLPRFKLETKYELNSLLKSLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 15847 - protein, 356 aa, Homo sapiens
MTLVLSMNRFCEPIVSEGAAEIAGYQTLWEADSYGGPSPPGPAQAPLQGDRGAGPPLAGSHYRGISNPITTSKITYFKRKYVEEEDFHPPLSSCSHKTISIFEERAHILYMSLEKLKFIDDPEVYLRRSVLINNLMKRIHGEIIMQNNWCFPACSFNGTSAQEWFMAQDCPYRKRPRMAKEECEKFHACCFYQECGGHYLNLPLSVNANVGSASTAASSPSASSSSSSSSSSPPLPLPSCSRQVDFDVGSASIYKSDGQIPANEIFVTNVRSLGVQEKAKLNDEKANDDTNRDGGPLSHEPVGNDLAFECKGQFYDYFETGYNERNNVNESWKKSLRKKEASPPSNKLCCSKGSKI

SEQ ID NO: 15848 - protein, 148 aa, Homo sapiens
MQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDA

SEQ ID NO: 15849 - protein, 131 aa, Homo sapiens
MRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEM

SEQ ID NO: 15850 - protein, 74 aa, Homo sapiens
MRCSQCRVAKYCSAKCQKKAWPDHKRECKCLKSCKPRYPPDSVRLLGRVVFKLMDGAPSESEKLYSFYDLESNI

SEQ ID NO: 15851 - protein, 369 aa, Homo sapiens
MRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 15852 - protein, 369 aa, Homo sapiens; identical to SEQ ID NO: 15851

SEQ ID NO: 15853 - protein, 258 aa, Homo sapiens
MEEDRDKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 15854 - protein, 804 aa, Homo sapiens
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATPALADVLPQTLQRNLHRLKMKMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLPESNNQVKTLNYGLGESEKNGNIVETPIPGCDINGKYENNYNAVFNLLPHTENHSPEHKFLCALCVSALCRQLEAASLQAIPTERIVNSSQLKAAVTPELCPDVTIWGVAMLRHMLQLQCNAQAMTTIQHTGPKGSIVTDSRQVRLATGIFPVISLLNHSCSPNTSVSFISTVATIRASQRIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLYVVEVRHGPSSVEMGHELFKLAQIFFNGFAVPEALSTIQKAEEVLSLHCGPWDDEIQELQKMKSCLLDLPPTPVGPAL

SEQ ID NO: 15855 - protein, 352 aa, Homo sapiens
MARGRKMSKPRAVEAAAAAAAVAATAPGPEMVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAHPWLKH

SEQ ID NO: 15856 - protein, 352 aa, Homo sapiens; identical to SEQ ID NO: 15855

SEQ ID NO: 15857 - protein, 440 aa, Homo sapiens
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSREILVKYLPSTDKQMDKKISILKDHGYIENLTFGWDGPSWRLLTALKLLCLEAEKFTCWKKVLLGEVISDTNEKTSLDIAQKICYYFIEETNAVLQKVSHMKDEKEALINQLTLVESLWTEELKILRASAETLHSLQTAFT

SEQ ID NO: 15858 - protein, 283 aa, Homo sapiens
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSRGWNQLCS

SEQ ID NO: 15859 - protein, 283 aa, Homo sapiens; identical to SEQ ID NO: 15858

SEQ ID NO: 15860 - protein, 307 aa, Homo sapiens
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSRGWNQLCS

SEQ ID NO: 15861 - protein, 307 aa, Homo sapiens; identical to SEQ ID NO: 15860

SEQ ID NO: 15862 - protein, 416 aa, Homo sapiens
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSREILVKYLPSTDKQMDKKISILKDHGYIENLTFGWDGPSWRLLTALKLLCLEAEKFTCWKKVLLGEVISDTNEKTSLDIAQKICYYFIEETNAVLQKVSHMKDEKEALINQLTLVESLWTEELKILRASAETLHSLQTAFT

SEQ ID NO: 15863 - protein, 440 aa, Homo sapiens; identical to SEQ ID NO: 15857

SEQ ID NO: 15864 - protein, 231 aa, Homo sapiens
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPY

SEQ ID NO: 15865 - protein, 225 aa, Homo sapiens
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDT

SEQ ID NO: 15866 - protein, 70 aa, Homo sapiens
MNESHKSEFIELRKWLKARKFQDSNLAPACFPGTGRGLMSQTSLQEGQMIISLPESCLLTTDTVIRSYLG

SEQ ID NO: 15867 - protein, 67 aa, Homo sapiens
MQKGKGRTSRIRRRKLCGSSESRGVNESHKSEFIELRKWLKARKFQDSNLAPACFPGTGRGLMSQTS

SEQ ID NO: 15868 - protein, 124 aa, Homo sapiens
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVV

SEQ ID NO: 15869 - protein, 1344 aa, Homo sapiens
MSRGKVIRLHRRKQDNISGGDSSATESWDEELSPSTVLYTATQHTPTSITLTVRRTKPKKRKKSPEKGRAAPKTKKIKAFREGSRKSLRMKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 15870 - protein, 1442 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 15871 - protein, 1344 aa, Homo sapiens; identical to SEQ ID NO: 15869

SEQ ID NO: 15872 - protein, 1442 aa, Homo sapiens; identical to SEQ ID NO: 15870

SEQ ID NO: 15873 - protein, 162 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITL

SEQ ID NO: 15874 - protein, 576 aa, Homo sapiens
MQVPQDGEDLAGQPWYHGLLSRQKAEALLQQNGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 15875 - protein, 483 aa, Homo sapiens
MEKTLLANLGTTASCPARARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVRGEQGLEEAGVRVTGKTGEEACSDLFSQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 15876 - protein, 309 aa, Homo sapiens
MLPEDSGGSPDAAASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQLRRSKAADEERSRRAQRARDEYRHHSLRAIQKGTVAGLSSMFRELGQSHEQEARLYHHLPDPGLPQPLALPVSRTWERPLRPVSRDVIVRWFKEEQLPRRAGFERNTKFIAPWFHGGNYHCFRRRVTSGTLRTEGQPTRLPSVV

SEQ ID NO: 15877 - protein, 357 aa, Homo sapiens
MLQQILHDMYIDPELLAELSDVQKHILFYKMREEQLRRWKERETWEALAQDEGLRPPKTKRAASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQLRRSKAADEERSRRAQRARDEYRHHSLRAIQKGTVAGLSSMFRELGQSHEQEARLYHHLPDPGLPQPLALPVRTWERPLRPVSRDVIVRWFKEEQLPRRAGFERNTKFIAPWFHGGNYHCFRRRVTSGTLRTEGQPTRLPSVV

SEQ ID NO: 15878 - protein, 215 aa, Homo sapiens
MLQQILHDMYIDPELLAELSDVQKHILFYKMREEQLRRWKERETWEALAQDEGLRPPKTKRASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQCE

SEQ ID NO: 15879 - protein, 431 aa, Homo sapiens
MLQQILHDMYIDPELLAELSDVQKHILFYKMREEQLRRWKERETWEALAQDEGLRPPKTKRASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQLRRSKAADEERSRRAQRARDEYRHHSLRAIQKGTVAGLSSMFRELGQSHEQEARLYHHLPDPGLPQPLALPVRTWERPLRPVSRDVIVRWFKEEQLPRRAGFERNTKFIAPWFHGIISREDAEALLENMTEGAFLVRVSEKIWGYTLSYRLQKGFKHFLVDASGDFYSFLGVDPNRHATLTDLVDFHKEEIITVSGGELLQEPCGQRDSPPDYHLLFE

SEQ ID NO: 15880 - protein, 339 aa, Homo sapiens
MAHALRRILYSTWCPADCQFAFMARNPRSPASKLFCHLFVGSQPGEVQILHLLLCRSFQLAYLLQHPEERAQPEPCPGPTGEVPLKPLSSSGGLVREPFGRDQLSQNVHALVSFRRLPAEGLVGSGKELPESEGRARHARLGNPYCSPTLVRKKAIRSKVIRSGAYRGCTYETQLQLSAREAFPAAWEAWPRGPGGHSCLVESEGSLTENIWAFAGISRPCALALLRRDVLGAFLLWPELGASGQWCLSVRTQCGVVPHQVFRNHLGRYCLEHLPAEFPSLEALVENHAVTERSLFCPLDMGRLNPTYEEQDCGPPGRPPRTLRPLSHAKSEAELQGLG

SEQ ID NO: 15881 - protein, 423 aa, Homo sapiens
MQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGSQPGEVQILHLLLCRSFQLAYLLQHPEERAQPEPCPGPTGEVPLKPLSSSGGLVREPFGRDQLSQNVHALVSFRRLPAEGLVGSGKELPESEGRARHARLGNPYCSPTLVRKKAIRSKVIRSGAYRGCTYETQLQLSAREAFPAAWEAWPRGPGGHSCLVESEGSLTENIWAFAGISRPCALALLRRDVLGAFLLWPELGASGQWCLSVRTQCGVVPHQVFRNHLGRYCLEHLPAEFPSLEALVENHAVTERSLFCPLDMGRLNPTYEEQDCGPPGRPPRTLRPLSHAKSEAELQGLG

SEQ ID NO: 15882 - protein, 126 aa, Homo sapiens
MQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGS

SEQ ID NO: 15883 - protein, 131 aa, Homo sapiens
MQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGSQPGEV

SEQ ID NO: 15884 - protein, 70 aa, Homo sapiens
MQKAGAGGRRASDCGLAPHRPRCITKFAQYVGSFPVDDLDTQESVWLVQQQLWALKDCPRRRAVILKFSL

SEQ ID NO: 15885 - protein, 175 aa, Homo sapiens
MYASSYPPPPQLSPRSHLCPPPPHPTPPQLNNLLLLEGRKSSLPSVAPTGSASAAEDSDLLTQPWYSGNCDRYAVESALLHLQKDGAYTVRPSSGPHGSQPFTLAVLLRGRVFNIPIRRLDGGRHYALGREGRNREELFSSVAAMVQHFMWHPLPLVDRHSGSRELTCLLFPTKP

SEQ ID NO: 15886 - protein, 143 aa, Homo sapiens
MPSGPLPRTSVVPRPTTAPQETRNGTADAASKEGRKSSLPSVAPTGSASAAEDGAYTVRPSSGPHGSQPFTLAVLLRGRVFNIPIRRLDGGRHYALGREGRNREELFSSVAAMVQHFMWHPLPLVDRHSGSRELTCLLFPTKP

SEQ ID NO: 15887 - protein, 631 aa, Homo sapiens
MNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGPGPGDLEGSWTRSCLHPKRASEHWELGRDGSESPKGWGPGAVAHICDPNTLGGPAVETGFHHVGQAGLELQTSSDPPNSASRSATSGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 15888 - protein, 237 aa, Homo sapiens
  MOD_RES (1)..(1): Any amino acid
XEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 15889 - protein, 308 aa, Homo sapiens
MNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPG

SEQ ID NO: 15890 - protein, 671 aa, Homo sapiens
MDPSYCPAHGFPSQDALWPLSSQQWSSAHYSEPAAGGCDGTEAMNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGLWPGDLEGSWTRSCLHPKRASEHWELGRDGSESPKGWGPGAVAHICWSRTPDLKRHLSSHIYLFVPLSPSPHVPHTVIPTSGEQGAETDPEAEPELELSDYPWFHGTLSRVKAAQLVLAGGPRNHGLFVIRQSETRPGEYVLTFNFQGKAKASHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 15891 - protein, 632 aa, Homo sapiens
MNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGDSEEDTELSCTRGGCLASRVASCSCELLTDAVDLPRPPETTAVGAVVTAPHSRGRDAVRESLIHVPLETFLQTLESPGGSGSDSNNTGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 15892 - protein, 411 aa, Homo sapiens
MTEMSEKENEPDDAATHSPPGTVSALQETKLQRFKRSLSLKTILRSKSLENFFLRSGSELKCPTEVLLTPPTPLPPPSPPPTASDRGLATPSPSPCPVPRPLAALKPVRLHSFQEHVFKRASPCELCHQLIVGNSKQGLRCKMCKVSVHLWCSEEISHQQCPGKTSTSFRRNFSSPLLVHEPPPVCATSKESPPTGDSGKVDPVYETLRYGTSLALMNRSSFSSTSESPTRSLSERDELTEDGEGSIRSSEEGPGDSASPVFTAPAESEGPGPEEKSPGQQLPKATLRKDVGPMYSYVALYKFLPQENNDLALQPGDRIMLVDDSNEDWWKGKIGDRVGFFPANFVQRVRPGENVWRCCQPFSGNKEQGYMSLKENQICVGVGRSKDADGFIRVSSGKKRGLVPVDALTEI

SEQ ID NO: 15893 - protein, 364 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 15894 - protein, 168 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDL

SEQ ID NO: 15895 - protein, 325 aa, Homo sapiens
MELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 15896 - protein, 1397 aa, Homo sapiens
MPSKPEGAAKTIGSYVPGPRSRSPSLNRLGGAGEDGKRPQPLWHVGSPFALGANKDSLSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 15897 - protein, 1336 aa, Homo sapiens
MENLPAVTTEEPTPMGRGPVGPSGGGSTRDQVRTVVMRPSVSWEKAGPEEAKAPVRGDEAPPARVAGPAAGTPPCQMGVYPTDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSLEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 15898 - protein, 822 aa, Homo sapiens
PTRASSSKKQRPPSSGSRWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSLEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERSSQPQQKQLHAFWAVLPTWWLLSSDLCLPRVFTPGLHLSP

SEQ ID NO: 15899 - protein, 94 aa, Homo sapiens
MENLPAVTTEEPTPMGRGPVGPSGGGSTRDQVRTVVMRPSVSWEKAGPEEAKAPVRGDEAPPARVAGPAAGTPPCQMGVYPTDLTLQLLAVRRK

SEQ ID NO: 15900 - protein, 1064 aa, Homo sapiens
MDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSLEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYT

SEQ ID NO: 15901 - protein, 1260 aa, Homo sapiens
MGVYPTDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSLEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 15902 - protein, 402 aa, Homo sapiens
MPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 15903 - protein, 640 aa, Homo sapiens
MVQSELQLQPRAGGRAEAASWGDRGNDKGGLGNPDMPSVSPGPQRPPKLSSLAYDSPPDYLQTVSHPEVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 15904 - protein, 756 aa, Homo sapiens
MEVLVLAGYRAQKEDELSLAPGDVVRQVRWVPARGWLRGEFGGRYGLFPERLVQEIPETLRGSGEARRPRCARRRGHPAKHPRPQRWCKVNFSYSPEQADELKLQAGEIVEMIKEIEDGWWLGKKNGQLGAFPSNFVELLDSGPPSLGNPDMPSVSPGPQRPPKLSSLAYDSPPDYLQTVSHPEVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 15905 - protein, 645 aa, Homo sapiens
MIKEIEDGWWLGKKNGQLGAFPSNFVELLDSGPPSLGNPDMPSVSPGPQRPPKLSSLAYDSPPDYLQTVSHPEVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 15906 - protein, 882 aa, Homo sapiens
MLLGASWLCASKAAAAAAQSEGDEDRPGERRRRRAAATAAGAGEDMDESSLLDLLECSVCLERLDTTAKVLPCQHTFCRRCLESIVCSRHELRCPECRILVGCGVDELPANILLVRLLDGIRQRPRAGTSPGGSPPARPIPGQSAAPTLAGGGGGAAGSTPGSPVFLSAAAGSTAGSLRELATSRTAPAAKNPCLLPYGKALYSYEGKEPGDLKFNKGDIIVLRRKVDEQWYHGELHGTQGFLPASYIQCIQPLPHAPPQGKALYDFEMKDKDQDKDCLTFTKDEILTVLRRVDENWAEGMLGDKIGIFPLLYVELNDSAKQLIEMDKPCPAAASSCNASLPSDSGAVASVAPSPTLSSSGAVSAFQRRVDGKKNTKKRHSFTALSVTHRSSQAASHRHSMEISAPVLISSSDPRAAARIGDLAHLSCAAPTQDVSSSAGSTPTAVPRAASVSGEQGTPPKVQLPLNVYLALYAYKPQKSDELELHKGEMYRVLEKCQDGWFKGASLRTGVSGVFPGNYVTPVSRVPAGGAGPPRNNVVGGSPLAKGITTTMHPGSGSLSSLATATRPALPITTPQAHAQHPTASPPTGSCLRHSAQPTASQARSTISTAAHSAAQAQDRPTATVSPLRTQNSPSRLPATSLRPHSVVSPQHSHQPPVQMCPRPAIPLTSAASAITPPNVSAANLNGEAGGGPIGVLSTSSPTNTGCKLDEKKSEKKEKKSGLLKLLAGASTKKKSRSPPSVSPTHDPQVAVDALLQGAVGPEVSSLSIHGRAGSCPIESEMQGAMGMEPLHRKAGSLDLNFTSPSRQAPLSMAAIRPEPKLLPRERYRVVVSYPPQSEAEIELKEGDIVFVHKKREDGWYKGTLQRNGRTGLFPGSFVESF

SEQ ID NO: 15907 - protein, 716 aa, Homo sapiens
MLLGASWLCASKAAAAAAQSEGDEDRPGERRRRRAAATAAGAGEDMDESSLLDLLECSVCLERLDTTAKVLPCQHTFCRRCLESIVCSRHELRCPECRILVGCGVDELPANILLVRLLDGIRQRPRAGTSPGGSPPARPIPGQSAAPTLAGGGGGAAGSTPGSPVFLSAAAGSTAGSLRELATSRTAPAAKNPCLLPYGKALYSYEGKEPGDLKFNKGDIIVLRRKVDEQWYHGELHGTQGFLPASYIQCIQPLPHAPPQGKALYDFEMKDKDQDKDCLTFTKDEILTVLRRVDENWAEGMLGDKIGIFPLLYVELNDSAKQLIEMDKPCPAAASSCNASLPSDSGAVASVAPSPTLSSSGAVSAFQRRVDGKKNTKKRHSFTALSVTHRSSQAASHRHSMEISAPVLISSSDPRAAARIGDLAHLSCAAPTQDVSSSAGSTPTAVPRAASVSGEQGTPPKVQLPLNVYLALYAYKPQKSDELELHKGEMYRVLEKCQDGWFKGASLRTGVSGVFPGNYVTPVSRVPAGGAGPPRNNVVGGSPLAKGITTTMHPGSGSLSSLATATRPALPITTPQAHAQHPTASPPTGSCLRHSAQPTASQARSTISTAAHSAAQAQDRPTATVSPLRTQNSPSRLPATSLRPHSVVSPQHSHQPPVQMCPRPAIPLTSAASAITPPNVSAANLNGEAGGGPIGVLSTSSPTNTGCKLDEKKSEK

SEQ ID NO: 15908 - protein, 56 aa, Homo sapiens
  MOD_RES (1)..(1): Any amino acid
XYRVVVSYPPQSEAEIELKEGDIVFVHKKREDGWYKGTLQRNGRTGLFPGSFVESF

SEQ ID NO: 15909 - protein, 342 aa, Homo sapiens
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 15910 - protein, 227 aa, Homo sapiens
MVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNLNQPIEVTALYSFEGQQPGDLNFQAGDRITVISKTDSHFDWWEGKLRGQTGIFPANYVTMN

SEQ ID NO: 15911 - protein, 227 aa, Homo sapiens; identical to SEQ ID NO: 15910

SEQ ID NO: 15912 - protein, 323 aa, Homo sapiens
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNLNQPIEVTALYSFEGQQPGDLNFQAGDRITVISKTDSHFDWWEGKLRGQTGIFPANYVTMN

SEQ ID NO: 15913 - protein, 342 aa, Homo sapiens; identical to SEQ ID NO: 15909

SEQ ID NO: 15914 - protein, 246 aa, Homo sapiens
MVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 15915 - protein, 51 aa, Homo sapiens
MNNPIPSNLKSEAKKAAKILREFTEITSRNGPDKIIPAHVIAKAKGLAILS

SEQ ID NO: 15916 - protein, 348 aa, Homo sapiens
MPGKQSEEGPAEAGASEDSEEEGLGGLTLEELQQGQEAARALEDMMTLSAQTLVRAEVDELYEEVRPLGQGCYGRVLLVTHRQKGTPLALKQLPKPRTSLRGFLYEFCVGLSLGAHSAIVTAYGIGIESAHSYSFLTEPVLHGDLMAFIQPKVGLPQPAVHRCAAQLASALEYIHARGLVYRDLKPENVLVCDPACRRFKLTDFGHTRPRGTLLRLAGPPIPYTAPELCAPPPLPEGLPIQPALDAWALGVLLFCLLTGYFPWDRPLAEADPFYEDFLIWQASGQPRDRPQPWFGLAAAADALLRGLLDPHPRRRSAVIAIREHLGRPWRQREGEAEAVGAVEEEAGQ

SEQ ID NO: 15917 - protein, 348 aa, Homo sapiens; identical to SEQ ID NO: 15916

SEQ ID NO: 15918 - protein, 393 aa, Homo sapiens [sequence omitted]

SEQ ID NO: 15919 - protein, 361 aa, Homo sapiens
MYQVPDRQESFWQSPYLLSFPECLTSFPWEELEHLNQASEEINQVELQLDEARTTYRRILQESARKLNTQGSHLGSCIEKARPYYEARRLAKEAQQETQKAALRYERAVSMHNAAREMVFVAEQGVMADKNRLDPTWQEMLNHATCKVNEAEEERLRGEREHQRVTRLCQQAEARVQALQKTLRRAIGKSRPYFELKAQFSQILEEHKAKVTELEQQVAQAKTRYSVALRNLEQISEQIHARRRGGLPPHPLGPRRSSPVGAEAGPEDMEDGDSGIEGAEGAGLEEGSSLGPGPAPDTDTLSLLSLRTVASDLQKCDSVEHLRGLSDHVSLDGQELGTRSGGRRGSDGGARGGRHQRSVSL

SEQ ID NO: 15920 - protein, 722 aa, Homo sapiens
MRPQDPALYPQAPHPLALGRASHPSQSRNTPPGRPRAAARCGPRRAPIGQSGRGREKWPTAASALGLLRRWRRSKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKAEDADEVMGKYLSEKLKLKDKWLGVWKTNPSVFFVKYEEASIPFVGILVEVTCEPYQDSSSRFKVTVSVAEPFSSNIANIPRDLVDEILEELEHSVPLLEVYPVEGQDTDIHVIALALEVVRFFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 15921 - protein, 653 aa, Homo sapiens
MASGSKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKAEDADEVMGKYLSEKLKLKDKWLGVWKTNPSVFFVKYEEASIPFVGILVEVTCEPYQDSSSRFKVTVSVAEPFSSNIANIPRDLVDEILEELEHSVPLLEVYPVEGQDTDIHVIALALEVVRFFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 15922 - protein, 534 aa, Homo sapiens
MGFLQLVRLDSNSRPQAEDADEVMGKYLSEKLKLKDKWLGVWKTNPSVFFVKYEEASIPFVGILVEVTCEPYQDSSSRFKVTVSVAEPFSSNIANIPRDLVDEILEELEHSVPLLEVYPVEGQDTDIHVIALALEVVRFFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 15923 - protein, 538 aa, Homo sapiens
MPALLLLVLLASSAGQARARPSNATSAEPAGPLPALLAHLRRLTGALTGGGGAASPGANGTRTGPAGGAGAAARAPPPAELCHGYYDVMGQYDATFNCSTGSYRFCCGTCHYRFCCEHRHMRLAQASCSNYDTPRWATTPPPLAGGAGGAGGAGGGPGPGQAGWLEGGRTGGAGGRGGEGPGGSTAYVVCGVISFALAVGVGAKVAFSKASRAPRAHRDINVPRALVDILRHQAGPGTRPDRARSSSLTPGIGGPDSMPPRTPKNLYNTVKTPNLDWRALPPPSPSLHYSTLSCSRSFHNLSHLPPSYEAAVKSELNRYSSLKRLAEKDLDEAYLKRRPLELPRGTLPLHALRRPGTGGGYRMEAWGGPEELGLAPAPNPRRVMSQEHLLGDGGRSRYEFTLPRARLVSQEHLLLSSPEALRQSREHLLSPPRSPALPPDPTARASLAASHSNLLLGPGGPPTPLRGLPPPSSLHAHHHHALHGSPQPAWMSDAGGGGGTLARRPPFQRQGTLEQLQFIPGHHLPQHLRTASKNEVTV

SEQ ID NO: 15924 - protein, 319 aa, Homo sapiens
MGWRRKRVPQRGRKAPPPQLHGNINNLYFPIRWRDRLHWDSPNPAAECQRHEVTLVSRKPGPGRITWDELAASGLPSCDAAVNLAGENILNPLRRWNETFQKEVIGSRLETTQLLAKAITKAPQPPKAWVLVTGVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 15925 - protein, 198 aa, Homo sapiens
MALSPNGEILRAREAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 15926 - protein, 293 aa, Homo sapiens
MRVLVGGGTGFIGTALTQLLNARGHEVTLVSRKPGPGRITWDELAASGLPSCDAAVNLAGENILNPLRRWNETFQKEVIGSRLETTQLLAKAITKAPQPPKAWVLVTGVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 15927 - protein, 155 aa, Homo sapiens
FHVASYGMSGAEKLQKEQIESINVGGTKLVIDVCVRRRVPRLIYTSTVNVAFGGKPIEQGDEDSVPYFPLDEHVDHYSRTKAIADQLTLMANGMPLPGGGTLRTCVLRPPGIYGPEEQRHLPRVAGHIKKRLFMFRFGDHKARMNWVHVHNLVQA

SEQ ID NO: 15928 - protein, 1493 aa, Homo sapiens
MENRPGSFQYVPVQLQGGAPWGFTLKGGLEHCEPLTVSKIEDGGKAALSQKMRTGDELVNINGTPLYGSRQEALILIKGSFRILKLIVRRRNAPVSRPHSWHVAKLLEGCPEAATTMHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQQKQQQQQQKQQEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 15929 - protein, 454 aa, Homo sapiens
MVPGQAQPQSPEMLLLPLLLPVLGAGSLNKDPSYSLQVQRQVPVPEGLCVIVSCNLSYPRDGWDESTAAYGYWFKGWTSPKTGAPVATNNQSREVEMSTRDRFQLTGDPGKGSCSLVIRDAQREDEAWYFFRVERGSRVRHSFVNNLFSVSAPALTQKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQRALDLSVQYPPENLRVMVSQANRTVLENLRNGTSLRVLEGQSLRLVCVTHSSPPARLSWTRWGQTVGPSQPSDPGVLELPRVQMEHEGEFTCHARHPLGSQRVSLSFSVH

SEQ ID NO: 15930 - protein, 481 aa, Homo sapiens
MLLLPLLLPVLGAGSLNKDPSYSLQVQRQVPVPEGLCVIVSCNLSYPRDGWDESTAAYGYWFKGWTSPKTGAPVATNNQSREVEMSTRDRFQLTGDPGKGSCSLVIRDAQREDEAWYFFRVERGSRVRHSFVNNLFSVSAPALTQKPDVYIPETLEPGQPVTVICVFNWAFKKCPAPSFSWTGAALSPRRTRPSTSHFSVLSFTPSPQDHDTDLTCHVDFSRKGVSAQRTVRLRVASLELQGNVIYLEVQKGQFLRLLCAADSQPPATLSWVLQDRVLSSSHPWGPRTLGLELRGVRAGDSGRYTCRAENRLGSQQRALDLSVQYPPENLRVMVSQANRTVLENLRNGTSLRVLEGQSLRLVCVTHSSPPARLSWTRWGQTVGPSQPSDPGVLELPRVQMEHEGEFTCHARHPLGSQRVSLSFSVHCKSGPMTGVVLVAVGEVAMKILLLCLCLILLRVRSCRRKAARAALGMEAADAVTD

SEQ ID NO: 15931 - protein, 307 aa, Homo sapiens
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPSGKKRPQARMLLLALFCVAVSVVWGVFRNEDQ

SEQ ID NO: 15932 - protein, 510 aa, Homo sapiens
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAVNTSLL

SEQ ID NO: 15933 - protein, 173 aa, Homo sapiens
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 15934 - protein, 173 aa, Homo sapiens; identical to SEQ ID NO: 15933

SEQ ID NO: 15935 - protein, 173 aa, Homo sapiens; identical to SEQ ID NO: 15933

SEQ ID NO: 15936 - protein, 1781 aa, Homo sapiens
MTTYRAIPSDGVDLAASCGARVGDVLPGPHTGDYAPLGFWAQNGSMSQPLGESPATATATATATTRPSPTTPAMPKMGVRARVADWPPKREALREHSNPSPSQDTDGTKATKMAHSMRSIQNGQPPTSTPASSGSKAFHRLSRRRSKDVEFQDGWPRSPGRAFLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRGWPETYDMNTSEPKTEQESITPGGRPPYRSNAPWQWSGPASHNSLPASKWATPTTPGHAQSLSRPLKQTPIVPFRESQPLHSKRPVSFPETPYTVSPAGADRVPPYRQPSGSFSTPGSATYVRYKPSPERYTAAPHPLLSLDPHFSHDGTSSGDSSSGGLTSQESTMERQKPEPLWHVPAQARLSAIAGSSGNKHPSRQDAAGKDSPNRHSKGEPQYSSHSSSNTLSSNASSSHSDDRWFDPLDPLEPEQDPLSKGGSSDSGIDTTLYTSSPSCMSLAKAPRPAKPHKPPGSMGLCGGGREAAGRSHHADRRREVSPAPAVAGQSKGYRPKLYSSGSSTPTGLAGGSRDPPRQPSDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGQSPQKGLQRTLSDESLCSGRREPSFASPAGLEPGLPSDVLFTSTCAFPSSTLPARRQHQHPHPPVGPGATPAAGSGFPEKKSTISASELSLADGRDRPLRRLDPGLMPLPDTAAGLEWSSLVNAAKAYEVQRAVSLFSLNDPALSPDIPPAHSPVHSHLSLERGPPTPRTTPTMSEEPPLDLTGKVYQLEVMLKQLHTDLQKEKQDKVVLQSEVASLRQNNQRLQEESQAASEQLRKFAEIFCREKKEL

SEQ ID NO: 15937 - protein, 148 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 15938 - protein, 148 aa, Homo sapiens; identical to SEQ ID NO: 15937

SEQ ID NO: 15939 - protein, 135 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIAD

SEQ ID NO: 15940 - protein, 148 aa, Homo sapiens; identical to SEQ ID NO: 15937

SEQ ID NO: 15941 - protein, 191 aa, Homo sapiens
MGYKLQDLTDVQIMARLQEENKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 15942 - protein, 305 aa, Homo sapiens
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 15943 - protein, 305 aa, Homo sapiens; identical to SEQ ID NO: 15942

SEQ ID NO: 15944 - protein, 84 aa, Homo sapiens
MYRYQSCRWKNTLFLCVSGYTSRGSPLSPQSSIDSELSTSELEDDSISMGYKLQDLTDVQIMARLQEESLRQDYASTSASVSRH

SEQ ID NO: 15945 - protein, 568 aa, Homo sapiens
MMAEQVKCASAGVSSGAGSGPVVNAELEVKKLQELVRKLEKQNEQLRSRAASAAAAPHLLLLPPPPPAAPPPAGLQPLGPRSPPAATATAAASGGLGPAFPGTFCLPSPAPSLLCSLAQPPEAPFVYFKPAAGFFGAGGGGPEPGGAGTPPGAAAAPPSPPPTLLDEVELLDLESVAAWRDEDDYTWLYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 15946 - protein, 349 aa, Homo sapiens
MEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 15947 - protein, 240 aa, Homo sapiens
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTG

SEQ ID NO: 15948 - protein, 568 aa, Homo sapiens; identical to SEQ ID NO: 15945

SEQ ID NO: 15949 - protein, 147 aa, Homo sapiens
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARM

SEQ ID NO: 15950 - protein, 12 aa, Homo sapiens
MGYKLQDLTDVQ

SEQ ID NO: 15951 - protein, 426 aa, Homo sapiens
MVGVGLCLRLLLFFRFKRTLDRICVLFLLGWHRKPRSDGSLFIERLYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 15952 - protein, 135 aa, Homo sapiens
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGG

SEQ ID NO: 15953 - protein, 845 aa, Homo sapiens
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLEEKKEEPATPAYTISATELLEKQATPREPELLYQNIAERVKELPSAGLVHYNFCTLPKRQFAPSYESRRQNQDRINKTVLYGTPRKCFVGQSKPNHPLLQAKPQSEPDYLEVLEKQTAISQL

SEQ ID NO: 15954 - protein, 845 aa, Homo sapiens; identical to SEQ ID NO: 15953

SEQ ID NO: 15955 - protein, 845 aa, Homo sapiens; identical to SEQ ID NO: 15953

SEQ ID NO: 15956 - protein, 110 aa, Homo sapiens
MARGNQRELARQKNMKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 15957 - protein, 62 aa, Homo sapiens
MARGNQRELARQKNMKKTQEISKGKRKEDSLTASQRKQRDSEIMQEKQKAANEKKSMQTREK

SEQ ID NO: 15958 - protein, 304 aa, Homo sapiens
MSSIKHLVYAVIRFLREQSQMDTYTSDEQESLEVAIQCLETVFKISPEDTHLAVSQPLTEMFTSSFCKNDVLPLSNSVPEDVGKADQLKDEGNNHMKEENYAAAVDCYTQAIELDPNNAVYYCNRAAAQSKLGHYTDAIKDCEKAIAIDSKYSKAYGRMGLALTALNKFEEAVTSYQKALDLDPENDSYKSNLKIAEQKLREVSSPTGTGLSFDMASLINNPAFISMAASLMQNPQVQQLMSGMMTNAIGGPAAGVGGLTDLSSLIQAGQQFAQQIQQQNPELIEQLRNHIRSRSFSSSAEEHS

SEQ ID NO: 15959 - protein, 195 aa, Homo sapiens
MSSIKHLVYAVIRFLREQSQMDTYTSDEQESLEVAIQCLETVFKISPEDTHLAVSQPLTEMFTSSFCKNDVLPLSNSVPEDVGKADQLKDEGNNHMKEENYAAAVDCYTQAIELDPNNAVYYCNRAAAQSKLGHYTDAIKDCEKAIAIDSKYSKAYGRMGLALTALNKFEEAVTSYQKALDLDPENDSYKSNLKI

SEQ ID NO: 15960 - protein, 78 aa, Homo sapiens
MQPQESHVHYSRWEDGSRDGVSLGAVSSTEEASRCRRISQRLCTGKLGIAMKVLGGVALFWIIFILGYLTGYYVHKCK

SEQ ID NO: 15961 - protein, 62 aa, Homo sapiens; identical to SEQ ID NO: 10195

SEQ ID NO: 15962 - protein, 92 aa, Homo sapiens
MAYSGQGQKVQKVMVQPINLIFRYLQNRSQIQVWLYEQVNMQIEGCIIGFDEYMNLVLDDAEEIHSKTKSRKQLGRIMLKGDNITLLQSVSN

SEQ ID NO: 15963 - protein, 98 aa, Homo sapiens
MQVPLTPLWELGLGRVVENADALAIAIVLNNQWSLVPNRGILYFLPVSMKLGGDRVSCQFLTATSHQWLHSVSLTQHMAQECLPSVSVSTAAIPRCWS

SEQ ID NO: 15964 - protein, 140 aa, Homo sapiens
MRRCLRVKTRRGQLGLASSCFEQHSCFSPRVNRILSAVQNTLCTGPSSQAPPQPPQASPPAAADHSRTPSLLASSHSASGGESLFQLYIASLAWPQNCCVLESCRRIPLGGLSSMENRRPLLRKGRLLRGQIHHSQTNEL

SEQ ID NO: 15965 - protein, 937 aa, Homo sapiens
MISAPDVVAFTKEEEYEEEPYNEPALPEEYSVPLFPFASQGANPWSKLSGAKFSRDFILISEFSEQVGPQPLLTIPNDTKVFGTFDLNYFSLRIMSVDYQASFVGHPPGSAYPKLNFVEDSKVVLGDSKEGAFAYVHHLTLYDLEARGFVRPFCMAYISADQHKIMQQFQELSAEFSRASECLKTGNRKAFAGELEKKLKDLDYTRTVLHTETEIQKKANDKGFYSSQAIEKANELASVEKSIIEHQDLLKQIRSYPHRKLKGHDLCPGEMEHIQDQASQASTTSNPDESADTDLYTCRPAYTPKLIKAKSTKCFDKKLKTLEELCDTEYFTQTLAQLSHIEHMFRGDLCYLLTSQIDRALLKQQHITNFLFEDFVEVDDRMVEKQESIPSKPSQDRPPSSSLEECPIPKVLISVGSYKSSVESVLIKMEQELGDEEYKEVEVTELSSFDPQENLDYLDMDMKGSISSGESIEVLGTEKSTSVLSKSDSQASLTVPLSPQVVRSKAVSHRTISEDSIEVLSTCPSEALIPDDFKASYPSAINEEESYPDGNEGAIRFQASISPPELGETEEGSIENTPSQIDSSCCIGKESDGQLVLPSTPAHTHSDEDGVVSSPPQRHRQKDQGFRVDFSVENANPSSRDNSCEGFPAYELDPSHLLASRDISKTSLDNYSDTTSYVSSVASTSSDRIPSAYPAGLSSDRHKKRAGQNALKFIRQYPFAHPAIYSLLSGRTLVVLGEDEAIVRKLVTALAIFVPSYGCYAKPVKHWASSPLHIMDFQKWKLIGLQRVASPAGAGTLHALSRYSRYTSILDLDNKTLRCPLYRGTLVPRLADHRTQIKRGSTYYLHVQSMLTQLCSKAFLYTFCHHLHLPTHDKETEELVASRQMSFLKLTLGLVNEDVRVVQYLAELLKLHYMQESPGTSHPMLRFDYVPSFLYKI

SEQ ID NO: 15966 - protein, 317 aa, Homo sapiens
MRKTSNSCIMENGHQPGAGPGDGPPEIAQNFSAPDPPRPRPVSLSLRLPHQPVTAITRVSDRFSGETSAAALSPMSAATLGGLNPSPSEVITPWTPSPSEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 15967 - protein, 461 aa, Homo sapiens
MEPAPDAQEARTVREALGRYEAALEGAVRALHEDMRGLQRGVERRVAEAMRLAGPLARTVADLQRDNQRLQAQLERLTRQVEALGLASGMSPVPGTPGTPSPPPAPGVPDRAPRLGSARFASHATFSLSGRGQSLDHDEASESEMRKTSNSCIMENGHQPGAGPGDGPPEIAQNFSAPDPPRPRPVSLSLRLPHQPVTAITRVSDRFSGETSAAALSPMSAATLGGLNPSPSEVITPWTPSPSEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 15968 - protein, 71 aa, Homo sapiens
MADEKPKEGVKTENNDHINLKVAGQDGSVVQFKIKRHTPLSKLMKAYCERQLEMEDEDTIDVFQQQTGGVY

SEQ ID NO: 15969 - protein, 95 aa, Homo sapiens
MADEKPKEGVKTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 15970 - protein, 418 aa, Homo sapiens
MAASMCDVFSFCVGVAGRARVSVEVRFVSSAKGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQGIGTSSLSQWVHACDTLELKPQDREQLDAFIDQLYKDIEAATGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 15971 - protein, 94 aa, Homo sapiens
MEQARDHLHLRWTTEQHMPEVEVQVKYRTAALSNQECQLYLRHSQQQQVLVVDFQAKLRQVFITETPRCGKKPYWNNEEAESKQNPGSIYCLLL

SEQ ID NO: 15972 - protein, 375 aa, Homo sapiens
MAGFNMGGDLREPAASIPPGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEGDLRSPQEQIILAPSLAKVDMEMTQLTQENADFATRDRYHHSSLVNREQLMPHY

SEQ ID NO: 15973 - protein, 743 aa, Homo sapiens
MLPLERTITYRDMSSFIQVKNHFNVVNVTCVSYRSTCFRDMRRFILDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAESISDLLGLGNIWAVRGISVAVLLALLGINLAGVKWIIRLQLLLLFLLAVSTLDFVVGSFTHLDPEHGFIGYSPELLQNNTLPDYSPGESFFTVFGVFFPAATGVMAGFNMGGDLREPAASIPPGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 15974 - protein, 515 aa, Homo sapiens
MRRAAAGGLAVGQLPGEGPAGEEGAALGKAMRGGGCSPHSPSGCLSGVMAGFNMGGDLREPAASIPPGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 15975 - protein, 240 aa, Homo sapiens
MQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 15976 - protein, 523 aa, Homo sapiens
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGTHIPLLAEDDVVGIEKMSSAAGVYIFIQSIAGLAGPPLAGLLVDQSKIYSRAFYSCAAGMALAAVCLALVRPCKMGLCQHHHSGETKVVSHRGKTLQDIPEDFLEMDLAKNEHRVHVQMEPV

SEQ ID NO: 15977 - protein, 150 aa, Homo sapiens
MRCAEGAWWFSPDGPAGSAASIWPAEGAEGLPGQLGRDRLEVVYSVPDNVPGQNGSRRPLVCKITGKCLSVCSEENAKAGGCSAFPLLLSQLGARMTGREHAHKGPELTTPDSGLPRPPNPALAGFRALAQHSPPLGTSTPSAVLLSAAT

SEQ ID NO: 15978 - protein, 150 aa, Homo sapiens; identical to SEQ ID NO: 15977

SEQ ID NO: 15979 - protein, 253 aa, Homo sapiens
MGELPGSEGMWENCPLGWVKKKASGTLAPLDFLLQRKRLWLWASEPVRPQPQGIHRFREARRQFCRMRGSRLTGGRKGFGSSGLRFGRGGFSEEVMPQPVLKAMRCAEGAWWFSPDGPAGSAASIWPAEGAEGLPGQLGRDRLEVVYSVPDNVPGQNGSRRPLVCKITGKCLSVCSEENAKAGGCSAFPLLLSQLGARMTGREHAHKGPELTTPDSGLPRPPNPALAGFRALAQHSPPLGTSTPSAVLLSAAT

SEQ ID NO: 15980 - protein, 274 aa, Homo sapiens
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 15981 - protein, 308 aa, Homo sapiens
LLVALLGGGLPAGFVGPLSRMAYQASNLPSLELVICRCLFHLPIALLLKLRGDPLLGPPDIRGRTCFCALLNVLNIGCAYSAVQVVPTGNAATVRKHSSTVCSAILTLCLESQVLSGYDWCGLLGSILGLIIIVGPGLWTLQEGTTGVYTGLGYVQAFLGGLALSLGLLVYRSLHFPSCLPTVAFLSGLVGLLGSVPGLFVLQSPVLPSDLLSWSCVGAVGILTLVSFTCVGYAVTKAHPALVCAVLHSEVVMALILQYFMLHETVAPSDIMGAGVVLGSIAIITARNLICERTGKVEEQRLKTKKKK

SEQ ID NO: 15982 - protein, 338 aa, Homo sapiens
MAGSHPYLNPPDSTHPSPPSAPPSLRWHQCCQPSDATNGLLVALLGGGLPAGFVGPLSHMAYQASNLPSLELLICRCLFHLPIALLLKLRGDPLLGPPDIRGRAYFYALLNVLSIGCAYSAVQVVPAGNAATVRKGSSTVCSAVLTLCLESQGLSGYDWCGLLGSILGLIIIVGPGLWTLQEGITGVYTALGYGQAFVGGLALSLGLLVYRSLHFPSCLPTVAFLSGLVGLLGSVPGLFVLQPPVLPSDLPSWSCVGAVGILALVSFTCVSYAVTKAHPALVCAVLHSEVVVALILQYYMLHETVAPSDIVGAGVVLGSIAIITAWNLSCEREGKVEE

SEQ ID NO: 15983 - protein, 435 aa, Homo sapiens
MEGQTPGSRGLPEKPHPATAAATLSSMGAVFILMKSALGAGLLNFPWAFSKAGGVVPAFLVELVSLVFLISGLVILGYAAAVSGQATYQGVVRGLCGPAIGKLCEACFLLNLLMISVAFLRVIGDQLEKLCDSLLSGTPPAPQPWYADQRFTLPLLSVLVILPLSAPREIAFQKYTSILGTLAACYLALVITVQYYLWPQGLVRESHPSLSPASWTSVFSVFPTICFGFQCHEAAVSIYCSMRKRSLSHWALVSVLSLLACCLIYSLTGVYGFLTFGTEVSADVLMSYPGNDMVIIVARVLFAVSIVTVYPIVLFLGRSVMQDFWRRSCLGGWGPSALADPSGLWVRMPLTILWVTVTLAMALFMPDLSEIVSIIGGISSFFIFIFPGLCLICAMGVEPIGPRVKCCLEVWGVVSVLVGTFIFGQSTAAAVWEMF

SEQ ID NO: 15984 - protein, 798 aa, Homo sapiens
MGKASPASGLSRPKTLVSPLRSNQWSLQKGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETERLQVLTSVRSRHIGWCRSCWRVFFFMIILEKKFSFPQCGSLRRMTYLLFLSELDTLCPGQPCPWAATAHQSWEEAGPGGLGRRQ

SEQ ID NO: 15985 - protein, 750 aa, Homo sapiens
MFGREFCYAMETALVTPILLQIGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETESVTPAGIDVCQISSHWLVPQLLESIFLYDYFRKKIFFSTMWFS

SEQ ID NO: 15986 - protein, 808 aa, Homo sapiens
MKMAPQNADPESMQVQELSVPLPDPQKAGGAEAENCETISEGSIDRIPMRLWVMHGAVMFGREFCYAMETALVTPILLQIGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETESVTPAGIDVCQISSHWLVPQLLESIFLYDYFRKKIFFSTMWFS

SEQ ID NO: 15987 - protein, 717 aa, Homo sapiens
MGKASPASGLSRPKTLVSPLRSNQWSLQKGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETESVV

SEQ ID NO: 15988 - protein, 445 aa, Homo sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 15989 - protein, 445 aa, Homo sapiens; identical to SEQ ID NO: 15988

SEQ ID NO: 15990 - protein, 445 aa, Homo sapiens; identical to SEQ ID NO: 15988

SEQ ID NO: 15991 - protein, 640 aa, Homo sapiens
MKISTTQIERRFEISSSLVGLIDGSFEIGNLFVIVFVSYFGSKLHRPKLIGIGCFLMGTGSILMALPHFFMGYYRYSKETNIDPSENSTSNLPNCLINQMLSLNRTPSEIIERGCVKESGSHMWIYVFMGNMLRGIGETPIVPLGISYIDDFAKEGHSSLYLGTVNVMGMTGLVFAFMLGSLFAKMYVDIGYVDLSTIRITPKDSRWVGAWWLGFLVSGIVSIISSIPFFFLPLNPNKPQKERKVSLFLHVLKTNDKRNQIANLTNRRKYITKNVTGFFQSLKSILTNPLYVIFVIFTLLHMSSYIASLTYIIKMVEQQYGWSASKTNFLLGVLALPAVAIGMFSGGYIIKKFKLSLVGLAKLAFCSATVHLLSQVLYFFLICESKSVAGLTLTYDGNSPVRSHVDVPLSYCNSECNCDESQWEPVCGNNGITYLSPCLAGCKSSSGNKEPIVFYNCSCVEVIGLQNKNYSAHLGECPRDDACTRKSYVYFVIQVLDAFLCAVGLTSYSVLVIRIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 15992 - protein, 687 aa, Homo sapiens
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETNIDPSENSTSNLPNCLINQMLSLNRTPSEIIERGCVKESGSHMWIYVFMGNMLRGIGETPIVPLGISYIDDFAKEGHSSLYLGTVNVMGMTGLVFAFMLGSLFAKMYVDIGYVDLSTIRITPKDSRWVGAWWLGFLVSGIVSIISSIPFFFLPLNPNKPQKERKVSLFLHVLKTNDKRNQIANLTNRRKYITKNVTGFFQSLKSILTNPLYVIFVIFTLLHMSSYIASLTYIIKMVEQQYGWSASKTNFLLGVLALPAVAIGMFSGGYIIKKFKLSLVGLAKLAFCSATVHLLSQVLYFFLICESKSVAGLTLTYDGNSPVRSHVDVPLSYCNSECNCDESQWEPVCGNNGITYLSPCLAGCKSSSGNKEPIVFYNCSCVEVIGLQNKNYSAHLGECPRDDACTRKSYVYFVIQVLDAFLCAVGLTSYSVLVIRIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 15993 - protein, 270 aa, Homo sapiens
MGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 15994 - protein, 270 aa, Homo sapiens; identical to SEQ ID NO: 15993

SEQ ID NO: 15995 - protein, 209 aa, Homo sapiens
MRAPGTLMWIIRYSSMPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 15996 - protein, 126 aa, Homo sapiens
MTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 15997 - protein, 158 aa, Homo sapiens
MSDTAVADTRRLNSKPQDLTDAYGPPSNFLEIDIFNPQTVGVGRARFTTYETNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKVRQ

SEQ ID NO: 15998 - protein, 162 aa, Homo sapiens
MSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKVRQ

SEQ ID NO: 15999 - protein, 132 aa, Homo sapiens
MTAAASLLASLLPALPPLNLQDAKFVEERRKQLQNYLRSVMNKVIQMVPEFAASPKKETLIQLMPFFVMGLQVGMYGLFHFGVMMDQPQPSLTRADESPCDRVLSPCAAHRKQRDCCLSWKAEPERFLVKKK

SEQ ID NO: 16000 - protein, 375 aa, Homo sapiens
MSGSQNNDKRQFLLERLLDAVKQCQIRFGGRKEIASDSDSRVTCLCAQFEAVLQHGLKRSRGLALTAAAIKQAAGFASKTETEPVFWYYVKEVLNKHELQRFYSLRHIASDVGRGRAWLRCALNEHSLERYLHMLLADRCRLSTFYEDWSFVMDEERSSMLPTMAAGLNSILFAINIDNKDLNGQSKFAPTVSDLLKESTQNVTSLLKESTQGVSSLFREITASSAVSILIKPEQETDPLPVVSRNVSADAKCKKERKKKKKVTNIISFDDEEDEQNSGDVFKKTPGAGESSEDNSDRSSVNIMSAFESPFGPNSNGSQSSNSWKIDSLSLNGEFGYQKLDVKSIDDEDVDENEDDVYGNSSGRKHRGHSESPEK

SEQ ID NO: 16001 - protein, 428 aa, Homo sapiens
MHSWAPLKVLHNDSDILFPVSGVGSYSPADAPLGSLENGTGPEDHVLPDPGLRYSVEASSPGHGSPLSSLLPSASVPESMTISELRQATVAMMNRKDELEEENRSLRNLLDGEMEHSAALRQEVDTLKRKVAEQEERQGMKVQALARENEVLKVQLKKYVGAVQMLKREGQTAEVPNLWSVDGEVTVAEQKPGEIAEELASSYERKLIEVAEMHGELIEFNERLHRALVAKEALVSQMRQELIDLRGPVPGDLSQTSEDQSLSDFEISNRALINVWIPSVFLRGKAANAFHVYQVYIRIKDDEWNIYRRYTEFRSLHHKLQNKYPQVRAYNFPPKKAIGNKDAKFVEERRKQLQNYLRSVMNKVIQMVPEFAASPKKETLIQLMPFFVDITPPGEPVNSRPKAASRFPKLSRGQPRETRNVEPQSGDL

SEQ ID NO: 16002 - protein, 408 aa, Homo sapiens
MHSWAPLKVLHNDSDILFPVSGVGSYSPADAPLGSLENGTGPEDHVLPDPGLRYSVEASSPGHGSPLSSLLPSASVPESMTISELRQATVAMMNRKDELEEENRSLRNLLDGEMEHSAALRQEVDTLKRKVAEQEERQGMKVQALARENEVLKVQLKKYVGAVQMLKREGQTAEVPNLWSVDGEVTVAEQKPGEIAEELASSYERKLIEVAEMHGELIEFNERLHRALVAKEALVSQMRQELIDLRGPVPGDLSQTSEDQSLSDFEISNRALINVWIPSVFLRGKAANAFHVYQVYIRIKDDEWNIYRRYTEFRSLHHKLQNKYPQVRAYNFPPKKAIGNKDAKFVEERRKQLQNYLRSVMNKVIQMVPEFAASPKKETLIQLMPFFVDWISLFGNGRDSSREEFSSS

SEQ ID NO: 16003 - protein, 249 aa, Homo sapiens
MDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 16004 - protein, 249 aa, Homo sapiens; identical to SEQ ID NO: 16003

SEQ ID NO: 16005 - protein, 268 aa, Homo sapiens
MLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 16006 - protein, 116 aa, Homo sapiens
MLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSAG

SEQ ID NO: 16007 - protein, 440 aa, Homo sapiens
MKMHFCIPVSQQRSDALGGRYVLYSVHLDGFLFCRVRYSQLHGWNEQLRRVFGNCLPPFPPKYYLAMTTAMADERRDQLEQYLQNVTMDPNVLRSDVFVEFLKLAQLNTFDIATKKAYLDIFLPNEQSIRIEIITSDTAERVLEVVSHKIGLCRELLGYFGLFLIRFGKEGKLSVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQAFLLSSCLKKMISEKMVKLAAENTEMQIEVPEQSKSKKYHIQQSQQKDYSSFLSRKSKIKIAKDDCVFGNIKEEDL

SEQ ID NO: 16008 - protein, 341 aa, Homo sapiens
MLGNTENWNTFDIATKKAYLDIFLPNEQSIRIEIITSDTAERVLEVVSHKIGLCRELLGYFGLFLIRFGKEGKLSVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQAFLLSSCLKKMISEKMVKLAAENTEMQIEVPEQSKSKKYHIQQSQQKDYSSFLSRKSKIKIAKDDCVFGNIKEEDL

SEQ ID NO: 16009 - protein, 403 aa, Homo sapiens
METYAEVGKEGKPSCASVDLQGDSSLQVEISDAVSERDKVKFTVQTKSCLPHFAQTEFSVVRQHEEFIWLHDAYVENEEYAGLIIPPAPPRPDFEASREKLQKLGEGDSSVTREEFAKMKQELEAEYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRDACLRADRVMRAHKCLADDYIPISAALSSLGTQEVNQLRTSFLKLAELFERLRKLEGRVASDEDLKLSDMLRYYMRDSQAAKDLLYRRLRALADYENANKALDKARTRNREVRPAESHQQLCCQRFERLSDSAKQELMDFKSRRVSSFRKNLIELAELELKHAKASTLILRNTLVALKGEP

SEQ ID NO: 16010 - protein, 127 aa, Homo sapiens
METYAEVGKEGKPSCASVDLQGDSSLQVEISDAVSERDKVKFTVQTKSCLPHFAQTEFSVVRQHEEFIWLHDAYVEGKATEIGRGGQLCHSGRVCQDEAGAGSVSAPSFPCHPQSPDVFPSYLPMNV

SEQ ID NO: 16011 - protein, 574 aa, Homo sapiens
MALKGRALYDFHSENKEEISIQQDEDLVIFSETSLDGWLQGQNSRGETGLFPASYVEIVRSGISTNHADYSSSPAGSPGAQVSLYNSPSVASPARSGGGSGFLSNQGSFEEDDDDDWDDWDDGCTVVEEPRAGGLGTNGHPPLNLSYPGAYPSQHMAFRPKPPLERQDSLASAKRGSVVGRNLNRFSCFVRSGVEAFILGDVPMMAKIAETYSIEMGPRGPQWKANPHPFACSVEDPTKQTKFKGIKSYISYKLTPTHAASPVYRRYKHFDWLYNRLLHKFTVISVPHLPEKQATGRFEEDFIEKRKRRLILWMDHMTSHPVLSQYEGFQHFLSCLDDKQWKMGKRRAEKDEMVGASFLLTFQIPTEHQDLQDVEDRVDTFKAFSKKMDDSVLQLSTVASELVRKHVGGFRKEFQKLGSAFQAISHSFQMDPPFCSEALNSAISHTGRTYEAIGEMFAEQPKNDLFQMLDTLSLYQGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 16012 - protein, 103 aa, Homo sapiens
MGQQSSVRRLKRSVPCESNEANEANEANKTMPETPTGDSDPQPAPKKMKTSESSTILVVRYRRNVKRTSPEELLNDHARENRINPDQMEEEEFIEITTERPKK

SEQ ID NO: 16013 - protein, 97 aa, Homo sapiens
MDKQSSAGGVKRSVPCDSNEANEMMPETSSGYSDPQPAPKKLKTSESSTILVVRYRRNFKRTSPEELVNDHARKNRINPLQMEEEEFMEIMVEIPAK

SEQ ID NO: 16014 - protein, 72 aa, Homo sapiens
MEQPTSSINGEKRKSPCESNNENDEMQETPNRDLAPEPSLKKMKTSEYSTVLAFCYRKAKKIHSNQLENDQS

SEQ ID NO: 16015 - protein, 180 aa, Homo sapiens
MEQPTSSTNGEKRKSPCESNNKKNDEMQEAPNRVLAPKQSLQKTKTIEYLTIIVYYYRKHTKINSNQLEKDQSRENSINPVQEEEDEGLDSAEGSSQEDEDLDSSEGSSQEDEDLDSSEGSSQEDEDLDSSEGSSQEDEDLDSSEGSSQEDEDLDPPEGSSQEDEDLDSSEGSSQEGGED

SEQ ID NO: 16016 - protein, 141 aa, Homo sapiens
MEQPTSSTNGEKTKSPCESNNKKNDEMQEVPNRVLAPEQSLKKTKTSEYPIIFVYYLRKGKKINSNQLENEQSQENSINPIQKEEDEGVDLSEGSSNEDEDLGPCEGPSKEDKDLDSSEGSSQEDEDLGLSEGSSQDSGED

SEQ ID NO: 16017 - protein, 99 aa, Homo sapiens
MEEPTSSTNENKMKSPCESNKRKVDKKKKNLHRASAPEQSLKETEKAKYPTLVFYCRKNKKRNSNQLENNQPTESSTDPIKEKGDLDISAGSPQDGGQN

SEQ ID NO: 16018 - protein, 72 aa, Homo sapiens
MEKPTSSTNGEKRKSPCDSNSKNDEMQETPNRDLVLEPSLKKMKTSEYSTVLVLCYRKTKKIHSNQLENDQS

SEQ ID NO: 16019 - protein, 336 aa, Homo sapiens
MQKHYTVAWFLYSAPGVDPSPPCRSLGWKRKREWSDESEEEPEKELAPEPEETWVVETLCGLKMKLKQQRVSPILLEHHKDFNSQLAPGVDPSPPHRSFCWKRKMEWWDKSEESEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRLHFFLALYLANDMEEDDEDSKQNIFHFLYGKNRSRIPLLRKRRFQLYRSMNPRARKNRSHIPLVRKRRFQLRRCMNPRARKNRSQIVLFQKRRFHFFCSMSCRAWVSPEELEEIQAYDPEHWVWARDRARLS

SEQ ID NO: 16020 - protein, 258 aa, Homo sapiens
MEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKPWFQLGHSMNPRARKNRSRIPLLRKRRFQLYRSTNPRARKNRSRIPLLRKRRFQLYRSMNSRARKNRSQIVLFQKRRFHFFCSMSCRAWVSPEELEEIQAYDPEHWVWARDRAHLS

SEQ ID NO: 16021 - protein, 258 aa, Homo sapiens; identical to SEQ ID NO: 16020

SEQ ID NO: 16022 - protein, 402 aa, Homo sapiens
MDRTETRFRKRGQITGKITTSRQPHPQNEQSPQRSTSGYPLQEVVDDEMLGPSAPGVDPSPPCRSLGWKRKREWSDESEEEPEKELAPEPEETWVVEMLCGLKMKLKQQRVSPILPEHHKDFNSQLAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKPWFQLGHSMNPRARKNRSRIPLLRKRRFQLYRSTNPRARKNRSRIPLLRKRRFQLYRSMNSRARKNRSQIVLFQKRRFHFFCSMSCRAWVSPEELEEIQAYDPEHWVWARDRAHLS

SEQ ID NO: 16023 - protein, 549 aa, Homo sapiens
MTSHQPQPQEEQSPQRSTSGYPLQEVVDDEVSGPSAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLEDPVIKRFLAWDKDLRVSDKYLLAMVIAYFSRAGLPSWQYQRIHFFLALYLANDMEEDDEAPKQKIFYFLYGKTHSHIPLRPKHWFQLCRPMNPRARKNCSQIALFQKRRFQFFCSMRCRAWVSPEELEEIQAYDPEHWVWARDRAHLS

SEQ ID NO: 16024 - protein, 172 aa, Homo sapiens
MKAKRRRVSLVLPEYYEAFNRLLEDPVIKRFLAWDKDLRVSDKYLLAMVIAYFSRAGLPSWQYQRIHFFLALYLANDMEEDDEAPKQKIFYFLYGKTHSHIPLRPKHWFQLCRPMNPRARKNCSQIALFQKRRFQFFCSMRCRAWVSPEELEEIQAYDPEHWVWARDRAHLS

SEQ ID NO: 16025 - protein, 237 aa, Homo sapiens
MASGQARPPFEEESPQPSTTVRSPEVVVDDEVPGPSAPWIDPSPQPQSLGLKRKSEWSDESEEELEEELELERAPEPEDTWVVETLCGLKMKLKRKRASSVLPEHHEAFNRLLGDPVVQKFLAWDKDLRVSDKYLLAMVIAYFSRAGLFSWQYQRIHFFLALYLASDMEEDNQAPKQDIFSFLYGKNYSQRPLFHKLRYQLLCSMRWRTWVSPEEMEEIQAYDPEHWVWARDRTLIS

SEQ ID NO: 16026 - protein, 402 aa, Homo sapiens
MDRTETRFRKRGQITGKITTSRQPHPQNEQSPQRSTSGYPLQEVVDDEMLGPSAPGVDPSPPCRSLGWKRKREWSDESEEEPEKELAPEPEETWVVEMLCGLKMKLKQQRVSSILPEHHKDFNSQLAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKPWFQLGHSMNPRARKNRSRIPLLRKRRFQLYRSTNPRARKNRSRIPLLRKRRFQLYRSMNSRARKNRSQIVLFQKRRFHFFCSMSCRAWVSPEELEEIQAYDPEHWVWARDRAHLS

SEQ ID NO: 16027 - protein, 258 aa, Homo sapiens; identical to SEQ ID NO: 16020

SEQ ID NO: 16028 - protein, 402 aa, Homo sapiens; identical to SEQ ID NO: 16026

SEQ ID NO: 16029 - protein, 514 aa, Homo sapiens
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREAALAKQAKIDFEEQFLKEKRFHDQIAVERAQARYEKHYSVCAEILDQIVDLSTKVADYRMLTNNLIPYKLMHDWKELFFNAKPIYEQASVKTLPANPSREQLTELEKRDLLDTNDYEEYKVPTDMK

SEQ ID NO: 16030 - protein, 619 aa, Homo sapiens
MPSQIGDRKWLHGLQAALQNFLKGYPAIVRQLHSAGRGKSDTSQKKPKELLESLLQADIVKFAHFLLDVMNVLSILSCVNKNRNSSIADIFATLESMLEMLQMYQTRLGPKERMVDSATHFHGNCLRGKENISAVRNIVLTHLIKRLQGCFRDASQNVVRATVIGSFKLWPTKINQEFGEKEVSILTAHYEPVLEAANVKLSEVDTEWSMLKLEIYARFQNIRKLTWDFVNSIYLHKYPNILTLVDLVLTLPASSAEAEHGFSQMKWTKSHMHAKIKAESIIGNKAFTDILIDLVTLNLGTNNFPSNWMHLTQPELQELTSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVKASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPDIKIILQRSEHVQGSDGERSPSRHTEEKK

SEQ ID NO: 16031 - protein, 1822 aa, Homo sapiens
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREAALAKQAKIDFEEQFLKEKRFHDQIAVERAQARYEKHYSVCAEILDQIVDLSTKVADYRMLTNNLIPYKLMHDWKELFFNAKPIYEQASVKTLPANPSREQLTELEKRDLLDTNDYEEYKNMVGEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGETMLSANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAASLAELPLPTPPPAPPPEPEKEKEIHQSHVASKTPTAKGKPQSEAPHGKQESLQEGKGKKGETALKRKGSPKGKSSGGKVPVKKSPADSTDTSPVAIVPQPPKPGSEEWVYVNEPVPEEMPLFLVPYWELIENSYINTIKTVLRHLREDQHTVLAYLYEIRTSFQEFLKRPDHKQDFVAQWQADFNSLPDDLWDDEETKAELHQRVNDLRDRLWDICDARKEEAEQERLDIINESWLQDTLGMTMNHFFSLMQAELNRFQDTKRLLQDYYWGMESKIPVEDNKRFTRIPLVQLDSKDNSESQLRIPLVPRISISLETVTPKPKTKSVLKGKMDNSLENVESNFEADEKLVMDTWQQASLAVSHMVAAEIHQRLMEEEKENQPADPKEKSPQMGANKKVKKEPPKKKQEDKKPKGKSPPMAEATPVIVTTEEIAEIKRKNELRVKIKEEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKGIIGNKAFTDILIDLVTLNLGTNNFPSNWMHLTQPELQELTSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVKASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPDIKIILQRSEHVQGSDGERSPSRHTEEKK

SEQ ID NO: 16032 - protein, 469 aa, Homo sapiens
MDNRNTQMYTEEEKTVNPFLPSTPGPKKAKGGGEAVETHPAPGPLPPPEVRDIGERREPDRAQQQPQKPAVAAGTQSLGNFRQGFMKCLLEVEKMEASHRRASKARSQTAQKSPRTLTPVPTSAPSLPQTPASVPASGPSWARLPAPGPEPAPMGAPVPTSMPCPVLLGPALDLGWRRMELLHQSSERTLSYAKARQEPEEQSLQKLYQNREKSEEQLTLKQEEAFRSYFEIFNGPGEVDAQSLKNILLLMGFSVTLAQVEDALMSADVNGDGRVDFKDFLAVMTDTRRFFCSVEQNALSDMAPHNPHTLLFEILSLLVEMLALPEAVLEEITNYYQKKLKEGTCKAQEMEAAVGRLRLQKLPYNPQQEESSEVPERKVLSILSRLKQQNYAPNLQSPYAQVPCILLCPQLDKKMVRRQPSNHYALDQCTPPGLDPDIRSPFFQSGSQGNREHNSDSRKWLSSVPARTH

SEQ ID NO: 16033 - protein, 200 aa, Homo sapiens
MDNRNTQMYTEGRTKAPGTQPSPGLRITIKRAGVEPIIPGVSKVMFPDASEVGSKKHLSSASRGPEKGPRLRDAFEKGPSELRIQEQGPPARPGKKQPSWVPQEGSQELQAGQDQSELGLLPSWVPEVPEGLQQLGSGKEIKGQQGRQRNRGIGEDQPPESCQAGHGGSRLLIPALLEAEGGRSPEVKTSLANMVKPCLY

SEQ ID NO: 16034 - protein, 446 aa, Homo sapiens
MAQPGAVEHACHPSTLGGQGGGSLEEVRDIGERREPDRAQQQPQKPAVAAGTQSLGNFRQGFMKCLLEVEKMEASHRRASKARSQTAQKSPRTLTPVPTSAPSLPQTPASVPASGPSWARLPAPGPEPAPMGAPVPTSMPCPVLLGPALDLGWRRMELLHQSSERTLSYAKARQEPEEQSLQKLYQNREKSEEQLTLKQEEAFRSYFEIFNGPGEVDAQSLKNILLLMGFSVTLAQVEDALMSADVNGDGRVDFKDFLAVMTDTRRFFCSVEQNALSDMAPHNPHTLLFEILSLLVEMLALPEAVLEEITNYYQKKLKEGTCKAQEMEAAVGRLRLQKLPYNPQQEESSEVPERKVLSILSRLKQQNYAPNLQSPYAQVPCILLCPQLDKKMVRRQPSNHYALDQCTPPGLDPDIRSPFFQSGSQGNREHNSDSRKWLSSVPARTH

SEQ ID NO: 16035 - protein, 269 aa, Homo sapiens
MKRSLNENSARSTAGCLPVPLFNQKKRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLGS

SEQ ID NO: 16036 - protein, 320 aa, Homo sapiens
MKRSLNENSARSTADWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 16037 - protein, 363 aa, Homo sapiens
MKRSLNENSARSTAGCLPVPLFNQKKRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 16038 - protein, 347 aa, Homo sapiens
MKRSLNENSARSTAGCLPVPLFNQKKRNRQPLTSNPLKDDSDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 16039 - protein, 363 aa, Homo sapiens; identical to SEQ ID NO: 16037

SEQ ID NO: 16040 - protein, 363 aa, Homo sapiens; identical to SEQ ID NO: 16037

SEQ ID NO: 16041 - protein, 424 aa, Homo sapiens
MGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMVTALPPACQLVQVALGCFALRLECEILGEVLAQLGTSVLPAEELLQARRASGDVASCVAWLQQRLAQDEEPPPLPPRGSPAAYRAPLDLYRDLQEDEGSEDASLYGEPSPGPDSPPAELAYRPPLWEQSAKLWGTGGRAWEPPAEELPQASSPPYGALEEGLEPEPSAFSFLSLRRELSRPGDLATPESSAAASPRRIRAEGVPASAYRSVSEPPGYQAHSCLSPGALPTLCCDTCRQLHAAHCAALPACRPGHSLRVLLGDAQRRLWLQRAQMDTLLYNSPGARP

SEQ ID NO: 16042 - protein, 152 aa, Homo sapiens
MGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMLCWSQSAGLCRVHG

SEQ ID NO: 16043 - protein, 183 aa, Homo sapiens
MKKVKKKRSEARRHRDSTSQHASSNSTSQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 16044 - protein, 192 aa, Homo sapiens
MKKVKKKRSEARRHRDSTSQHASSNSTSQQPSPESTPQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 16045 - protein, 192 aa, Homo sapiens; identical to SEQ ID NO: 16044

SEQ ID NO: 16046 - protein, 192 aa, Homo sapiens; identical to SEQ ID NO: 16044

SEQ ID NO: 16047 - protein, 192 aa, Homo sapiens; identical to SEQ ID NO: 16044

SEQ ID NO: 16048 - protein, 6 aa, Homo sapiens
  MOD_RES (1)..(1): Any amino acid
XCLLHH

SEQ ID NO: 16049 - protein, 334 aa, Homo sapiens
MPLEVVVELQIRAISCPGVFLPGKQDVYLGVYLMNQYLETNSFPSAFPIMIQESMRFEKGIAPKIEFSTRTAIRECVFLHRNRFLEERHESRRPLSTSHEPIFPLNTIKMKLKENNLNRLPKGMQARAPSQYSTRHFFQDQPAQLNLGNNFKISGGSKPPFVVRHVDSAKPFGENISEHHLRRSRRKSKFSDFPFPTRRASSLDSLAANVKVIKEPDERIVLRSDSSSCLDSSQFGKSSSSKQGDADFHGKASFATYQHSTSPGPLDQPLLRERFHPGSQSTWKNIHERVCSLLTSHRAQLHQNKEDSTSEVNYIIERPSYPLKKYSLHEQRYF

SEQ ID NO: 16050 - protein, 300 aa, Homo sapiens
MSPSMLTGNSPRGCRLPSISSTTCGRQLEKVPEKRDSGMTEVERTYSANCSDFLESKGCFANTTPSGKSVSSSSSVETGPSVSEPPGLPRVSAYVDTTADLDRKLSFSHSDHSSEMSLPEVQKDKYPEEFSLLKLQTKDGHRPEWTFYPRFSSNIHTYHVGKQCFFNGVFLGNKRSLSERTVDKCFGRKKYDIDPRNGIPKLTPGDNPYMYPEQSKGFHKAGSMLPPVNFSIVPYEKKFDTFIPLEPLPQIPNLPFWVKEKANSLKNEIQEVEELDNWQPAVPLMHMLHLSGALDFPRQS

SEQ ID NO: 16051 - protein, 300 aa, Homo sapiens; identical to SEQ ID NO: 16050

SEQ ID NO: 16052 - protein, 445 aa, Homo sapiens
MSPPGMWQPGVQQPGISQQVPSHPDMSQPGMSQQVPSQPGIRQPDTSQSCKNQTDMSQPDANQSSLSDSNQTGIIQPSPSLLGMNQMDMNQWSASLYEMNQVDMKQPSMSQAGMRQSGTNLPDINQPGMKQPGTWQLGRSQPGMWPQSLSELVLSEASISQPGPPQRAPSQSGPRQSSTSQAGTNQSGISQPVMWQLDMRQSGGSQPSMRQVGTSQSGTSQIGMSQPGTWQTGLSQPVPRQPNKSPPGMWQRGMWQPGMSQQVPSQLGMRQPGTSQSSKNQTGMSHPGRGQPGIWEPGPSQPGLSQQDLNQLVLSQPGLSQPGRSQPSVSQMGMRQTSMDYFQIRHAEAGDCPEILRLIKELAACENMLDAMELTAADLLRDGFGDNPLFYCLIAEVNDQQKPSGKLTVGFAMYYFTYDSWTGKVLYLEDFYVTQAYQDSHHNSM

SEQ ID NO: 16053 - protein, 508 aa, Homo sapiens
MSPPGMWQPGVQQPGISQQVPSHPDMSQPGMSQQVPSQPGIRQPDTSQSCKNQTDMSQPDANQSSLSDSNQTGIIQPSPSLLGMNQMDMNQWSASLYEMNQVDMKQPSMSQAGMRQSGTNLPDINQPGMKQPGTWQLGRSQPGMWPQSLSELVLSEASISQPGPPQRAPSQSGPRQSSTSQAGTNQSGISQPVMWQLDMRQSGGSQPSMRQVGTSQSGTSQIGMSQPGTWQTGLSQPVPRQPNKSPPGMWQRGMWQPGMSQQVPSQLGMRQPGTSQSSKNQTGMSHPGRGQPGIWEPGPSQPGLSQQDLNQLVLSQPGLSQPGRSQPSVSQMGMRQTSMDYFQIRHAEAGDCPEILRLIKELAACENMLDAMELTAADLLRDGFGDNPLFYCLIAEVNDQQKPSGKLTVGFAMYYFTYDSWTGKVLYLEDFYVTQAYQGLGIGAEMLKRLSQIAITTQCNCMHFLVVIWNQASINYYTSRGALDLSSEEGWHLFRFNREELLDMAWEE

SEQ ID NO: 16054 - protein, 632 aa, Homo sapiens
MNQSGTNQSSLSDSNQAGINQPSTNSLGMNQMDMNQGSASLYEMNQVDMKQPSMSQAGMRQSGTNLPDINQPDMKQPDTWQLGRSQPGMLQQELSQLVLSKAGISQPDPSQPGPSQSGPSQSRMRQIGTNQSGMSQPVMQQLDSQSGGSQPSMRQVGTSQLGTSQIGMSQPGTWQTGLSQPVLRQPNMSPPGMWQPGVQQPGISQQVPSHPDMSQPGMSQQVPSQPGIRQPDTSQSCKNQTDMSQPDANQSSLSDSNQTGIIQPSPSLLGMNQMDMNQWSASLYEMNQVDMKQPSMSQAGMRQSGTNLPDINQPGMKQPGTWQLGRSQPGMWPQSLSELVLSEASISQPGPPQRAPSQSGPRQSSTSQAGTNQSGISQPVMWQLDMRQSGGSQPSMRQVGTSQSGTSQIGMSQPGTWQTGLSQPVPRQPNKSPPGMWQRGMWQPGMSQQVPSQLGMRQPGTSQSSKNQTGMSHPGRGQPGIWEPGPSQPGLSQQDLNQLVLSQPGLSQPGRSQPSVSQMGMRQTSMDYFQIRHAEAGDCPEILRLIKELAACENMLDAMELTAADLLRDGFGDNPLFYCLIAEVNDQQKPSGKLTVGFAMYYFTYDSWTGKVLYLEDFYVTQAYQDSHHNSM

SEQ ID NO: 16055 - protein, 63 aa, Homo sapiens
MTRIKISVCICFRYFEFCFFYALNILFQKVSEANSQTELLLRPHCKNILFNVSFMIDLQAAHF

SEQ ID NO: 16056 - protein, 353 aa, Homo sapiens
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSAFITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRGGTPGHHLLPLRSSSSLERGMHMPTSPTFLEGNTVV

SEQ ID NO: 16057 - protein, 262 aa, Homo sapiens
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 16058 - protein, 255 aa, Homo sapiens
MASSDLEQLCSHVNEKIGNIKKTLSLRNCGQEPTLKTVLNKIGDEIIVINELLNKLELEIQYQEQTNNSLKELCESLEEDYKDIEHLKENVPSHLPQVTVTQSCVKGSDLDPEEPIKVEEPEPVKKPPKEQRSIKEMPFITCDEFNGVPSYMKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 16059 - protein, 126 aa, Homo sapiens [sequence omitted]

SEQ ID NO: 16060 - protein, 258 aa, Homo sapiens
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVETKPSVYFIKFDDDFHIYVYDLVKKS

SEQ ID NO: 16061 - protein, 258 aa, Homo sapiens; identical to SEQ ID NO: 16060

SEQ ID NO: 16062 - protein, 77 aa, Homo sapiens
MKTPFGKAAAGQRSRTGAGHGSVSVTMIKRKAAHKKHRSRPTSQPRGNIVGCRIQHGWKDGDEPLTQWKGTVLDQLL

SEQ ID NO: 16063 - protein, 258 aa, Homo sapiens
MKTPFGKAAAGQRSRTGAGHGSVSVTMIKRKAAHKKHRSRPTSQPRGNIVGCRIQHGWKDGDEPLTQWKGTVLDQVPVNPSLYLIKYDGFDCVYGLELHRDERVSSLEVLPNRVASSRISDTHLAEIMVGKAVEHIFETEEGSKNEWRGMVLAQAPVMNTWFYITYEKDPVLYMYQLLDDYKDGDLRILQDSNDSPLAEREPGEVIDSLVGKQVEYAKDDGSKRTGMVIHQVEAKPSVYFIKFDDDFHIYVYDLVKTS

SEQ ID NO: 16064 - protein, 249 aa, Homo sapiens
MSPPTVPPMGVDGVSAYLMKKRHTHRKQRRKPTFLTRRNIVGCRIQHGWKEGNEPVEQWKGTVLEQVSVKPTLYIIKYDGKDSVYGLELHRDKRVLALEILPERVPTPRIDSRLADSLIGKAVEHVFEGEHGTKDEWKGMVLARAPVMDTWFYITYEKDPVLYMYTLLDDYKDGDLRIIPDSNYYFPTAEQEPGEVVDSLVGKQVEHAKDDGSKRTGIFIHQVVAKPSVYFIKFDDDIHIYVYGLVKTP

SEQ ID NO: 16065 - protein, 231 aa, Homo sapiens
MKKRHTHRKQRRKPTFLTRRNIVGCRIQHGWKEGNEPVEQWKGTVLEQVSVKPTLYIIKYDGKDSVYGLELHRDKRVLALEILPERVPTPRIDSRLADSLIGKAVEHVFEGEHGTKDEWKGMVLARAPVMDTWFYITYEKDPVLYMYTLLDDYKDGDLRIIPDSNYYFPTAEQEPGEVVDSLVGKQVEHAKDDGSKRTGIFIHQVVAKPSVYFIKFDDDIHIYVYGLVKTP

SEQ ID NO: 16066 - protein, 263 aa, Homo sapiens
MGQTALAGGSSSTPTPQALYPDLSCPEGLEELLSAPPPDLGAQRRHGWNPKDCSENIEVKEGGLYFERRPVAQSTDGARGKRGYSRGLHAWEISWPLEQRGTHAVVGVATALAPLQTDHYAALLGSNSESWGWDIGRGKLYHQSKGPGAPQYPAGTQGEQLEVPERLLVVLDMEEGTLGYAIGGTYLGPAFRGLKGRTLYPAVSAVWGQCQVRIRYLGERRAEPHSLLHLSRLCVRHNLGDTRLGQVSALPLPPAMKRYLLYQ

SEQ ID NO: 16067 - protein, 263 aa, Homo sapiens; identical to SEQ ID NO: 16066

SEQ ID NO: 16068 - protein, 807 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 16069 - protein, 442 aa, Homo sapiens
MRRTRRPRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKLYNGRAKGRQFGSKCNSGDRIGCGIEPVSFDVQTAQIFFTKNGKRVGSTIMPMSPDGLFPAVGMHSLGEEVRLHLNAELGREDDSVMMVDSYEDEWGRLHDVRVCGTLLEYLGKGKSIVDVGLAQARHPLSTRSHYFEVEIVDPGEKCYIALGLARKDYPKNRHPGWSRGSVAYHADDGKIFHGSGVGDPFGPRCYKGDIMGCGIMFPRDYILDSEGDSDDSCDTVILSPTARAVRNVRNVMYLHQEGEEEEEEEEEEEDGEEIEPEHEGRKVVVFFTRNGKIIGKKDAVVPSGGFFPTIGMLSCGEKVKVDLHPLSG

SEQ ID NO: 16070 - protein, 452 aa, Homo sapiens
MNSGILQVFQRALTCPICMNYFLDPVTIDCGHSFCRPCLYLNWQDTAVLAQCSECKKTTRQRNLNTDICLKNMAFIARKASLRQFLSSEEQICGMHRETKKMFCEVDKSLLCLPCSNSQEHRNHIHCPIEWAAEERREELLKKMQSLWEKACENLRNLNMETTRTRCWKDYVSLRIEAIRAEYQKMPAFLHEEEQHHLERLRKEGEDIFQQLNESKARMEHSRELLRGMYEDLKQMCHKADVELLQAFGDILHRYESLLLQVSEPVNPELSAGPITGLLDSLSGFRVDFTLQPERANSHIFLCGDLRSMNVGCDPQDDPDITGKSECFLVWGAQAFTSGKYYWEVHMGDSWNWAFGVCNNYWKEKRQNDKIDGEEGLFLLGCVKEDTHCSLFTTSPLVVQYVPRPTSTVGLFLDCEGRTVSFVDVDQSSLIYTIPNCSFSPPLRPIFCCSHF

SEQ ID NO: 16071 - protein, 196 aa, Homo sapiens
MATSVLCCLRCCRDGGTGHIPLKEMPAVQLDTQHMGTDVVIVKNGRRICGTGGCLASAPLHQNKSYFEFKIQSTGIWGIGVATQKVNLNQIPLGRDMHSLVMRNDGALYHNNEEKNRLPANSLPQEGDVVGITYDHVELNVYLNGKNMHCPASGIRGTVYPVVYVDDSAILDCQFSEFYHTPPPGFEKILFEQQIF

SEQ ID NO: 16072 - protein, 157 aa, Homo sapiens
MATSVLCCLRCCRDGGTGHIPLKEMPAVQLDTQHMGIWGIGVATQKVNLNQIPLGRDMHSLVMRNDGALYHNNEEKNRLPANSLPQEGDVVGITYDHVELNVYLNGKNMHCPASGIRGTVYPVVYVDDSAILDCQFSEFYHTPPPGFEKILFEQQIF

SEQ ID NO: 16073 - protein, 352 aa, Homo sapiens
MDFREILMIASKGQGVNNVPKRYSLAVGPPKKDPKVKGVQSAAVQAFLKRKEEELRRKALEEKRRKEELVKKRIELKHDKKARAMAKRTKDNFHGYNGIPIEEKSKKRQATESHTSQGTDREYEMEEENEFLEYNHAESEQEYEEEQEPPKVESKPKVPLKSAPPPMNFTDLLRLAEKKQFEPVEIKVVKKSEERPMTAEELREREFLERKHRRKKLETDGKLPPTVSKKAPSQKESVGTKLSKGSGDRHPSSKGMPLPHAEKKSRPSMANEKHLALSSSKSMPGERIKAGSGNSSQPSLREGHDKPVFNGAGKPHSSTSSPKHVWKENKYMKRDWLFYFQCIEYIRLLFIF

SEQ ID NO: 16074 - protein, 685 aa, Homo sapiens
MDFREILMIASKGQGVNNVPKRYSLAVGPPKKDPKVKGVQSAAVQAFLKRKEEELRRKALEEKRRKEELVKKRIELKHDKKARAMAKRTKDNFHGYNGIPIEEKSKKRQATESHTSQGTDREYEMEEENEFLEYNHAESEQEYEEEQEPPKVESKPKVPLKSAPPPMNFTDLLRLAEKKQFEPVEIKVVKKSEERPMTAEELREREFLERKHRRKKLETDGKLPPTVSKKAPSQKESVGTKLSKGSGDRHPSSKGMPLPHAEKKSRPSMANEKHLALSSSKSMPGERIKAGSGNSSQPSLREGHDKPVFNGAGKPHSSTSSPSVPKTSASRTQKSAVEHKAKKSLSHPSHSRPGPMVTPHNKAKSPGVRQPGSSSSSAPGQPSTGVARPTVSSGPVPRRQNGSSSSGPERSISGSKKPTNDSNPSRRTVSGTCGPGQPASSSGGPGRPISGSVSSARPLGSSRGPGRPVSSPHELRRPVSGLGPPGRSVSGPGRSISGSIPAGRTVSNSVPGRPVSSLGPGQTVSSSGPTIKPKCTVVSETISSKNIISRSSNGQMNGMKPPLSGYRAAQGPQRLPFPTGYKRQREYEEEDDDDDEYDSEMEDFIEDEGEPQEEISKHIREIFGYDRKKYKDESDYALRYMESSWKEQQKEEAKSLRLGMQEDLEEMRREEEEMQRRRAKKLKRR

SEQ ID NO: 16075 - protein, 495 aa, Homo sapiens
MQWSPTPGASACLGWASSLACSTAPTLLGRAGRGPLMAAKWFKEFPLNLKTVSERAKPGGGGGKLRKNSEAGGAGPGPGKGRKNSAAELGSGRAGVGPKDSRLSRDSLQGLIQAAAGKGRKNSRATEEEPHRGATKSSGCSTYINRLIKVDTQEKNGKSNYPSSSSSSSSSSSSASSSPSSLGPELDKGKIIKQQETVIILEDYADPYDAKRTKGQRDAERVGENDGYMEPYDAQQMITEIRRRGSKDPLVKALQLLDSPCEPADGGLKSETLAKRRSSKDLLGKPPQLYDTPYEPAEGGPRAEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALKTSQGCVHIIVAQTKDNKYTLNQTSAVFDSIPEVVHYYSNEKLPFKGAEHMTLLYPVHSKLH

SEQ ID NO: 16076 - protein, 423 aa, Homo sapiens
MQQEGGPVRSAPCRTGTLEGSRQGSPGHRKRASPKGSLSSAQPHSWMLTPSPLNSHCAHREPISSSPQPVANGPKQKKKSNWRSTTRLRIIRLRDRLEPRPLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 16077 - protein, 433 aa, Homo sapiens
MVAQSLSDAHHALTIMLSERLWLGLELLNFTRRKISSDPPPYNFLEAREAALGHRWRMQQEGGPVRSAPCRTGTLEGSRQGSPGHRKRASPKGSLSSAQPHSWMLTPSPLNSHCAHREPISSSPQPVANGPKQKKKSNWRSTTRLRIIRLRDRLEPRPLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 16078 - protein, 369 aa, Homo sapiens
MQQEGGPVRSAPCRTGTLEGSRQGSPGHRKRASPKGSLSSAQPHSWMLTPSPLNSHCAHREPISSSPQPVANGPKQKKKSNWRSTTRLRIIRLRDRLEPRPLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLSGCAKRPATWCATVRPARMTSPSPSRAARDSCT

SEQ ID NO: 16079 - protein, 366 aa, Homo sapiens
MLLSGAPPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 16080 - protein, 255 aa, Homo sapiens
MARAKALLGGPGEELEADTEYLDPFDAQPHPAPPDDGYMEPYDAQWVMSELPGRGVQLYDTPYEEQDPETADGPPSGQKPRQSRMPQEDERPADEYDQPWEWKKDHISRAFAVQFDSPEWERTPGSAKELRRPPPRSPQPAERVDPALPLEKQPWFHGPLNRADAESLLSLCKEGSYLVRLSETNPQDCSLSLRSSQGFLHLKFARTRENQVVLGQHSGPFPSVPELVLHYSSRPLPVQGAEHLALLYPVVTQTP

SEQ ID NO: 16081 - protein, 340 aa, Homo sapiens
MAKWLRDYLSFGGRRPPPQPPTPDYTESDILRAYRAQKNLDFEDPYEDAESRLEPDPAGPGDSKNPGDAKYGSPKHRLIKVEAADMARAKALLGGPGEELEADTEYLDPFDAQPHPAPPDDGYMEPYDAQWVMSELPGRGVQLYDTPYEEQDPETADGPPSGQKPRQSRMPQEDERPADEYDQPWEWKKDHISRAFAVQFDSPEWERTPGSAKELRRPPPRSPQPAERVDPALPLEKQPWFHGPLNRADAESLLSLCKEGSYLVRLSETNPQDCSLSLRSSQGFLHLKFARTRENQVVLGQHSGPFPSVPELVLHYSSRPLPVQGAEHLALLYPVVTQTP

SEQ ID NO: 16082 - protein, 1183 aa, Homo sapiens
MGNAPSQDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQPNYWSFKTRSSRHTQGAQPGLADQAAKLSYASAESLETMSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 16083 - protein, 1035 aa, Homo sapiens
MSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELEVFERSSVSSLPPTPRRQLIPTLLSPQDLGPPGGSAPGPTRKSGGGSVPPMKVVTPGASRLKAAQGQAGSPDKSKHGKQRAEYMRIQAQQQV

SEQ ID NO: 16084 - protein, 921 aa, Homo sapiens
MGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQV

SEQ ID NO: 16085 - protein, 488 aa, Homo sapiens
MEPFLRRRLAFLSFFWDKIWPAGGEPDHGTPGSLDPNTDPVPTLPAEPCSPFPQLFLALYDFTARCGGELSVRRGDRLCALEEGGGYIFARRLSGQPSAGLVPITHVAKASPETLSDQPWYFSGVSRTQAQQLLLSPPNEPGAFLIRPSESSLGGYSLSVRAQAKVCHYRVSMAADGSLYLQKGRLFPGLEELLTYYKANWKLIQNPLLQPCMPQKAPRQDVWERPHSEFALGRKLGEGYFGEVWEGLWLGSLPVAIKVIKSANMKLTDLAKEIQTLKGLRHERLIRLHAVCSGGEPVYIVTELMRKGNLQAFLGTPEGRALRLPPLLGFACQVAEGMSYLEEQRVVHRDLAARNVLVDDGLACKVADFGLARLLKDDIYSPSSSSKIPVKWTAPEAANYRVFSQKSDVWSFGVLLHEVFTYGQCPYEGMTNHETLQQIMRGYRLPRPAACPAEVYVLMLECWRSSPEERPSFATLREKLHAIHRCHP

SEQ ID NO: 16086 - protein, 155 aa, Homo sapiens
MAVPGCNKDSVRAGCKKCGYPGHLTFECRNFLRVDPKRDIVLDVSSTSSEDSDEENEELNKLQALQEKRINEEEEKKKEKSKEKIKLKKKRKRSYSSSSTEEDTSKQKKQKYQKKEKKKEKKSKSKKGKHHKKEKKKRKKEKHSSTPNSSEFSRK

SEQ ID NO: 16087 - protein, 567 aa, Homo sapiens
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLQTGKLSKNKRKKMRRKRKQQKRLLEERLRDLQRLEAMEAATQAEDSGLRLDGGSGSTSSSGCHPGGARAGPSPASSSPAPGGGRSLSAGSQTSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 16088 - protein, 533 aa, Homo sapiens
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 16089 - protein, 39 aa, Homo sapiens
MTGFFKGAEDRYSSHLWRPQGGPRSKGPGPRSWNTESLR

SEQ ID NO: 16090 - protein, 340 aa, Homo sapiens
MVTLRKRTLKVLTFLVLFIFLTSFFLNYSHTMVATTWFPKQMVLELSENLKRLIKHRPCTCTHCIGQRKLSAWFDERFNQTMQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 16091 - protein, 340 aa, Homo sapiens; identical to SEQ ID NO: 16090

SEQ ID NO: 16092 - protein, 49 aa, Homo sapiens
MVTLRKRTLKVLTFLVLFIFLTSFFLNYSHTMVATTWFPKQMVLELSEN

SEQ ID NO: 16093 - protein, 340 aa, Homo sapiens; identical to SEQ ID NO: 16090

SEQ ID NO: 16094 - protein, 340 aa, Homo sapiens; identical to SEQ ID NO: 16090

SEQ ID NO: 16095 - protein, 72 aa, Homo sapiens
MVTLRKRTLKVLTFLVLFIFLTSFFLNYSHTMVATTWFPKQMVLELSENLKRLIKHRPCTCTHCIGQRKLSA

SEQ ID NO: 16096 - protein, 47 aa, Homo sapiens
MVTLRKRTLKVLTFLVLFIFLTSFFLNYSHTMVATTWFPKQMVLELS

SEQ ID NO: 16097 - protein, 406 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 16098 - protein, 75 aa, Homo sapiens
MIHTNLKKKFSCCVLVFLLFAVICVWKEKKKGSYYDSFKLQTKEFQVLKSLGKLAMGSDSQSVSSSSTQDPHRGR

SEQ ID NO: 16099 - protein, 113 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIW

SEQ ID NO: 16100 - protein, 127 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYK

SEQ ID NO: 16101 - protein, 42 aa, Homo sapiens
MIHTNLKKKFSCCVLVFLLFAVICVWKEKKKGSYYDSFKLQT

SEQ ID NO: 16102 - protein, 97 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWN

SEQ ID NO: 16103 - protein, 45 aa, Homo sapiens
MIHTNLKKKFSCCVLVFLLFAVICVWKEKKKGSYYDSFKLQTKEF

SEQ ID NO: 16104 - protein, 91 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEA

SEQ ID NO: 16105 - protein, 406 aa, Homo sapiens; identical to SEQ ID NO: 16097

SEQ ID NO: 16106 - protein, 98 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNK

SEQ ID NO: 16107 - protein, 175 aa, Homo sapiens
MNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 16108 - protein, 25 aa, Homo sapiens
MIHTNLKKKFSCCVLVFLLFAVICV

SEQ ID NO: 16109 - protein, 291 aa, Homo sapiens
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSELSVQHADSLENIDESAVAESREERMGGAGGEGSDDDTSLT

SEQ ID NO: 16110 - protein, 89 aa, Homo sapiens
MEKLAASTEPQGPRPVLGRESVQVPDDQDFRSFRSECEAEVGWNLTYSRAGVSVWVQAVEMDRTLHKIKCRMECCDVPAETLYDVLHDI

SEQ ID NO: 16111 - protein, 252 aa, Homo sapiens
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSEL

SEQ ID NO: 16112 - protein, 12 aa, Homo sapiens
MEKLAASTEPQG

SEQ ID NO: 16113 - protein, 191 aa, Homo sapiens
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDP

SEQ ID NO: 16114 - protein, 291 aa, Homo sapiens; identical to SEQ ID NO: 16109

SEQ ID NO: 16115 - protein, 138 aa, Homo sapiens
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLP

SEQ ID NO: 16116 - protein, 4700 aa, Homo sapiens
MANVQVAVRVRPLSKRETKEGGRIIVEVDGKVAKIRNLKVDNRPDGFGDSREKVMAFGFDYCYWSVNPEDPQYASQDVVFQDLGMEVLSGVAKGYNICLFAYGQTGSGKTYTMLGTPASVGLTPRICEGLFVREKDCASLPSSCRIKVSFLEIYNERVRDLLKQSGQKKSYTLRVREHPEMGPYVQGLSQHVVTNYKQVIQLLEEGIANRITAATHVHEASSRSHAIFTIHYTQAILENNLPSEMASKINLVDLAGSERADPSYCKDRIAEGANINKSLVTLGIVISTLAQNSQVFSSCQSLNSSVSNGGDSGILSSPSGTSSGGAPSRRQSYIPYRDSVLTWLLKDSLGGNSKTIMVATVSPAHTSYSETMSTLRYASSAKNIINKPRVNEDANLKLIRELREEIERLKALLLSFELRNFSSLSDENLKELVLQNELKIDQLTKDWTQKWNDWQALMEHYSVDINRRRAGVVIDSSLPHLMALEDDVLSTGVVLYHLKEGTTKIGRIDSDQEQDIVLQGQWIERDHCTITSACGVVVLRPARGARCTVNGREVTASCRLTQGAVITLGKAQKFRFNHPAEAAVLRQRRQVGEAAAGRGSLEWLDLDGDLAASRLGLSPLLWKERRALEEQCDEDHQTPRDGETSHRAQIQQQQSYVEDLRHQILAEEIRAAKELEFDQAWISQQIKENQQCLLREETWLASLQQQQQEDQVAEKELEASVALDAWLQTDPEIQPSPFVQSQKRVVHLQLLRRHTLRAAERNVRRKKVSFQLERIIKKQRLLEAQKRLEKLTTLCWLQDDSTQEPPYQVLSPDATVPRPPCRSKLTSCSSLSPQRLCSKHMPQLHSIFLSWDPSTTLPPRPDPTHQTSEKTSSEEHLPQAASYPARTGCLRKNGLHSSGHGQPCTARAALARKGASAPDACLTMSPNSVGIQEMEMGVKQPHQMVSQGLASLRKSANKLKPRHEPKIFTSTTQTRGAKGLADPSHTQAGWRKEGNLGTHKAAKGASCNSLYPHGPRQTAGHGKAVKTFWTEYKPPSPSRASKRHQRVLATRVRNITKKSSHLPLGSPLKRQQNTRDPDTMVPLTDFSPVMDHSREKDNDLSDTDSNYSLDSLSCVYAKALIEPLKPEERKWDFPEPENSESDDSQLSEDSLAEKRYQSPKNRLGGNRPTNNRGQPRTRTRASVRGFTAASDSDLLAQTHRSFSLDSLIDAEEELGEDQQEEPFPGSADEIPTETFWHLEDSSLPVMDQEAICRLGPINYRTAARLDAVLPMSSSFYLDPQFQPHCELQPHCELQPHCELQPHCEQAESQVEPSYSEQADSLQGMQLSRESPLMSMDSWFSCDSKINPSSPPGIVGSLCPSPDMQEFHSCKGERPGYWPNTEELKPSDAETVLPYSSKLHQGSTELLCSARDEHTASAADTSRLSLWGIQRLIQPGADGTFQGRCIPDMTQQGSSEASHNSSVSNVLAASATTLTHVGSTHERDWSALQQKYLLELSCPVLEAIGAPKPAYPYLEEDSGSLAQASSKGGDTLLPVGPRVSSNLNLNNFPVHLSRIRRLRAEKEQDSLNAKLEGVSDFFSTSEKEASYDETYSADLESLSASRSTNAQVFATENAIPDSMTEACEVKQNNLEECLQSCRKPGLMTSSDEDFFQKNACHSNVTTATKADHWSQGWAPLRKNSAVQPGQLSPDSHYPLEEEKTDCQESSKEAVRRHINVSFALPSGPELYLHSAPWNPLSSSLQPPLLETFYVTKSRDALTETALEIPACREVRVPSPPPREAWGFGHNHQALQGAYLKNNLPVLLQNQNSKIASSQQVTAEIPVDLNTREVIRESGKCPGNITEESHDSVYSSVTQNRHFLPSTSTKVCEFENQVVILNKKHSFPALEGGEVTAQSCCGASSDSTESGKSLLFRESEAREEEELDQNTVLRQTINVSLEKDMPGESAVSLKSRSVDRRVSSPVMVAQGGGPTPKWEGKNETGLLEKGLRPKDSSEEFKLPGTKPAYERFQLVACPQERNPSECKSQEMLNPNREPSGKKQNKRVNNTDEMARLIRSVMQLENGILEIESKQNKQVHASHTPGTDKELVFQDQKEQEKTDHAFRPDSSGNPLPSKDQPSSPRQTDDTVFRDSEAGAMEVNSIGNHPQVQKITPNPFRSREGVRESEPVREHTHPAGSDRPARDICDSLGKHTTCREFTNTSLHPQRMKALARALPLQPRLERSSKNNGQFVKASASLKGQPWGLGSLEELETVKGFQESQVAEHVSSSNQEEPKAQGKVEEMPMQRGGSLQEENKVTQKFPSLSQLCRDTFFRQETVSPLLSRTEFCTAPLHQDLSNTLPLNSPRWPRRCLHVPVALGISSLDCVLDLTMLKIHNSPLVTGVEHQDQSTETRSHSPEGNVRGRSSEAHTAWCGSVRSMAMGSHSQSGVPESIPLGTEDRISASTSPQDHGKDLRITLLGFSTSEDFASEAEVAVQKEIRVSSLNKVSSQPEKRVSFSLEEDSDQASKPRQKAEKETEDVGLTSGVSLAPVSLPRVPSPEPRLLEPSDHASMCLAILEEIRQAKAQRKQLHDFVARGTVLSYCETLLEPECSSRVAGRPQCKQIDQSSSDQTRNEGEAPGFHVASLSAEAGQIDLLPDERKVQATSLSADSFESLPNTETDREPWDPVQAFSHAAPAQDRKRRTGELRQFAGASEPFICHSSSSEIIEKKKDATRTPSSADPLAPDSPRSSAPVEEVRRVVSKKVVAALPSQAPYDDPRVTLHELSQSVPQETAEGIPPGSQDSSPEHQEPRTLDTTYGEVSDNLLVTAQGEKTAHFESQSVTCDVQNSTSASGPKQDHVQCPEASTGFEEGRASPKQDTILPGALTRVALEAPTQQCVQCKESVGSGLTEVCRAGSKHSRPIPLPDQRPSANPGGIGEEAPCRHPREALDGPVFSRNPEGSRTLSPSRGKESRTLPCRQPCSSQPVATHAYSSHSSTLLCFRDGDLGKEPFKAAPHTIHPPCVVPSRAYEMDETGEISRGPDVHLTHGLEPKDVNREFRLTESSTCEPSTVAAVLSRAQGCRSPSAPDVRTGSFSHSATDGSVGLIGVPEKKVAEKQASTELEAASFPAGMYSEPLRQFRDSSVGDQNAQVCQTNPEPPATTQGPHTLDLSEGSAESKLVVEPQHECLENTTRCFLEKPQFSTELRDHNRLDSQAKFVARLKHTCSPQEDSPWQEEEQHRDQASGGGEGFAQGVNPLPDEDGLDGCQILDAGREEVAVAKPPVSKILSQGFKDPATVSLRQNETPQPAAQRSGHLYTGREQPAPNHRGSLPVTTIFSGPKHSRSSPTPQFSVVGSSRSLQELNLSVEPPSPTDEDTQGPNRLWNPHLRGYSSGKSVARTSLQAEDSNQKASSRLDDGTTDHRHLKPATPPYPMPSTLSHMPTPDFTTSWMSGTLEQAQQGKREKLGVQVRPENWCSQMDKGMLHFGSSDISPYALPWRPEEPARISWKQYMSGSAVDVSCSQKPQGLTLSNVARCSSMDNGLEDQNSPFHSHLSTYANICDLSTTHSSTENAQGSNEAWEVFRGSSSIALGDPHIPTSPEGVAPTSGHDRRPQFRGPSGEADCLRSKPPLAKGSAAGPVDEIMLLYPSEAGCPVGQTRTNTFEQGTQTLGSRRHWSSTDISFAQPEASAVSAFDLASWTSMHNLSLHLSQLLHSTSELLGSLSQPDVARREQNTKRDIPDKAPQALMMDGSTQTTVDEGSQTDLTLPTLCLQTSEAEPQGANVILEGLGSDTSTVSQEEGDVPGVPQKREAEETAQKMAQLLYLQEESTPYKPQSPSIPSSHLRFQKAPVGQHLPSVSPSVSDAFLPPSSQPEESYCLVVSSPSPSSPHSPGLFPSTSEYPGDSRVQKKLGPTSALFVDRASSPILTLSASTQEPGLSPGSLTLSAPSTHPVEGHQKLDSSPDPVDAPRTPMDNYSQTTDELGGSQRGRSSLQRSNGRSFLELHSPHSPQQSPKLQFSFLGQHPQQLQPRTTIGVQSRLLPPPLRHRSQRLGNSFVPEKVASPEHCPLSGREPSQWQSRTENGGESSASPGEPQRTLDRPSSWGGLQHLSPCPVSELTDTAGLRGSALGLPQACQPEELLCFSCQMCMAPEHQHHSLRDLPVHNKFSNWCGVQKGSPGGLDMTEEELGASGDLSSEKQEQSPPQPPNDHSQDSEWSKREQIPLQVGAQNLSLSVELTEAKLHHGFGEADALLQVLQSGTGEALAADEPVTSTWKELYARQKKAIETLRRERAERLGNFCRTRSLSPQKQLSLLPNKDLFIWDLDLPSRRREYLQQLRKDVVETTRSPESVSRSAHTPSDIELMLQDYQQAHEEAKVEIARARDQLRERTEQEKLRIHQKIISQLLKEEDKLHTLANSSSLCTSSNGSLSSGMTSGYNSSPALSGQLQFPENMGHTNLPDSRDVWIGDERGGHSAVRKNSAYSHRASLGSCCCSPSSLSSLGTCFSSSYQDLAKHVVDTSMADVMAACSDNLHNLFSCQATAGWNYQGEEQAVQLYYKVFSPTRHGFLGAGVVSQPLSRVWAAVSDPTVWPLYYKPIQTARLHQRVTNSISLVYLVCNTTLCALKQPRDFCCVCVEAKEGHLSVMAAQSVYDTSMPRPSRKMVRGEILPSAWILQPITVEGKEVTRVIYLAQVELGAPGFPPQLLSSFIKRQPLVIARLASFLGR

SEQ ID NO: 16117 - protein, 189 aa, Homo sapiens
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 16118 - protein, 216 aa, Homo sapiens
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 16119 - protein, 314 aa, Homo sapiens
MSFLVSKPERIRTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGPVPAPS

SEQ ID NO: 16120 - protein, 690 aa, Homo sapiens
MGAVARAHGGLRVARARESVAGGRHRGAGRPGARAAGAAAGLVRAEAGGRRAGRGRRPGRGLPTGGGGLAAAAVGREVAQGLCDAIRLDGGLDLLLRLLQAPELETRVQAARLLEQILVAENRDRVARIGLGVILNLAKEREPVELARSGSGILEHMFKHSEETCQRLVAAGGLDAVLYWCRRTDPALLRHCALALGNCALHGGQAVQRRMVEKRAAEWLFPLAFSKEDELLSLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 16121 - protein, 722 aa, Homo sapiens
MVLTLLLSAYKLCRFFAMSGPRRGAERLAVPGPDGGGGTGPWWAAGGPGPRVSPGAGTEVQDALERALPELQQALSALKQAGGARAVGAGLAEVFQLVEEAWLLAVGREVAQGLCDAIRLDGGLDLLLRLLQAPELETRVQAARLLEQILVAENRDRVARIGLGVILNLAKEREPVELARSGSGILEHMFKHSEETCQRLVAAGGLDAVLYWCRRTDPALLRHCALALGNCALHGGQAVQRRMVEKRAAEWLFPLAFSKEDELLSLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 16122 - protein, 417 aa, Homo sapiens
MASSKLREPVDEVFDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 16123 - protein, 445 aa, Homo sapiens
MASSKLREPVDEVFDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQAQLLAHAQEALSNSWCLVQDFGSTQIGMESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 16124 - protein, 13 aa, Homo sapiens
MASSKLREPVDEV

SEQ ID NO: 16125 - protein, 674 aa, Homo sapiens
MAEVPEDYDSGPDEDGELEPERPELPGLHKLYENAEPDTMAKADSKLPAEIYQEPQPETEEEDFKEGEPDSAKNVQLKPGGTSQEGIAKESKRDVPSETEPGIHQEVKSETSREMGEFFKDLEAPMDETHKESDLEPPEEAKPNVTEDVFLESAMETDPDPVPPTETMSEVSGATVRERNLELLEEETEPGVPEESLRVQHEETGLEPPEQTKQDFPSEKLGESLEETDLQPPKMTKPETPEETQRESTEKKRTEPPEQARLEFLEKEPRKSSEEAGLEPPEETQPEVPEEMQRKATEEKGTELPERTKPDFPDHKPRKSTDENVPEPLEEIKLEFPEEESRKTNEETILEQSEMMKPESPEEIRKSNEKKNPQPPEETGPVLPQEINPQVEEKTQTKPTEKILELPDETKPRETHVEFSKEDRPEPIKSKYSVGNDELEHREPKRGKLSLSDKFRKEYYALGSLRESEESIGTHYEFLQPLQKLLNVSEECSYSDPSESQTELSEFVHEKEVVDLSQELKERVSEDDETQPEKGTELQFEHLNWDPEEVAEWISQLGFPQYKECFITNFISGRKLIHVNCSNLPQMGITNFEDMKAISRHTQELLEIEEPLFKRSISLPYRDIIGLYLEQKGHTGIKSDSLTLSEFVKAAGLQDYAPEITAPEENEELPCTEP

SEQ ID NO: 16126 - protein, 221 aa, Homo sapiens
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFAGV

SEQ ID NO: 16127 - protein, 520 aa, Homo sapiens
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKEEAVCFDSELDEHIKWFQQEYVKTEKDWREIDKRMSQTLEIRRKMIGSRTPLKDILKLFPFLKCPYQMFREFQLLTRTDIYKKTRHILESYSENILTSFSVVDNPINIVLQEKMKHYTDEDMLKYMKMTATCLLLPDVFGDDPSLFVIMNEQVQVSTPVLEVKNPFNMEVCEFSLYLERERLTKVDDCVTALAALVAAFHVFRIECPRRLSQTFNFLETLIFDMHSPYFPSLKEKENEVGFQHPLT

SEQ ID NO: 16128 - protein, 520 aa, Homo sapiens; identical to SEQ ID NO: 16127

SEQ ID NO: 16129 - protein, 520 aa, Homo sapiens; identical to SEQ ID NO: 16127

SEQ ID NO: 16130 - protein, 173 aa, Homo sapiens
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIR

SEQ ID NO: 16131 - protein, 694 aa, Homo sapiens
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTSPSLGGQGRQNLWFANPGGSNSMPSQSRSSVQRTHSLPVHSSPQAILMFPPDCPVPGPDLEINPTLESLCLSMTEHALGDGTDKTSTI

SEQ ID NO: 16132 - protein, 663 aa, Homo sapiens
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTPQPWRPGPTEPVVCQPWRQQQHAQSEPQLCAAHPLAPGPLVTPGHSHVPSRLPGSWA

SEQ ID NO: 16133 - protein, 173 aa, Homo sapiens
MCTNIVYEWLKALQLPQYAESFVDNGYDDLEVCKQIGDPDLDAIGVLAPAHRRRILEAVRRLREQDANAAGLYFTLEPQPAPPGPPADAVPTGRRGEPCGGPAQGTRGDSRGHTTAPRSRELVSYPKLKLKIMIRDKLVRDGIHLSKPPYSRKVPMAGILEYLMNWPKSSQSR

SEQ ID NO: 16134 - protein, 446 aa, Homo sapiens
MAVNPLLTPTGQQTIPLIPSPFGPPTVDRDVLPSTVAPTDPRQFCVPSQFGSSVLPNTNMANVLSSRIYPGWGILPPESIKAVARRNEMIQRHHTARTEMEMYAIYQQRRMEKINPKGLAGLGIPFLYGSSVPAAPAAYHGRSMLPAGDLHFHRSTLRNLQGNPMLAATAPHFEESWGQRCRRLRKNTGNQKALDSDAESSKSQAEEKILGQTHAVPYEEDHYAKDPDIEAPSNQKSSETNEKPTTALANTCGELEPTHRKPWGSHTTTLKAKAWDDGKEEASEQIFATCDEKNGVCPPVPRPSLPGTHALVTIGGNLSLDEDIQKWTVDDVHSFIRSLPGCSDYAQVFKDHAIDGETLPLLTEEHLRGTMGLKLGPALKIQSQVSQHVGSMFYKKTLSFPIRQAFDQPADTSPLLDPNSWSDTMNIFCPQDTIIPKGIERGSMRN

SEQ ID NO: 16135 - protein, 446 aa, Homo sapiens; identical to SEQ ID NO: 16134

SEQ ID NO: 16136 - protein, 926 aa, Homo sapiens
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRTRESLASNTSSIVESNRRQNPALSPAHGGAGPAFNFRASAEPPTNEAEKLQKPSNCLQASVTSV

SEQ ID NO: 16137 - protein, 863 aa, Homo sapiens
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRN

SEQ ID NO: 16138 - protein, 1384 aa, Homo sapiens [sequence omitted]

SEQ ID NO: 16139 - protein, 1366 aa, Homo sapiens
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 16140 - protein, 1309 aa, Homo sapiens
MREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 16141 - protein, 150 aa, Homo sapiens
MSGWIATSKTRMQDFWSLLTFSSDLVDVKDSGDYPLTAPGLSWKKFQGSFCEFVGTLVCRCQYILLHDDFPMDNLISLLTGFSDSQVCAFCHTSTLAAMKLMTSLVRVALQLSLHEDINQRQYEAERNKGPGQRAPERLESLLEKHKELH

SEQ ID NO: 16142 - protein, 150 aa, Homo sapiens; identical to SEQ ID NO: 16141

SEQ ID NO: 16143 - protein, 296 aa, Homo sapiens
MLSPKDILRKDLKLVHGYPMTCAFASNWEKIEQFHSRPDDIVIATYPKSGTTWVSEIIDMILNDGDIEKCKRGFITEKVPMLEMTLPGLRTSGIEQLEKNPSPRIVKTHLPTDLLPKSFWENNCKMIYLARNAKDVSVSYYHFDLMNNLQPFPGTWEEYLEKFLTGKVAYGSWFTHVKNWWKKKEEHPILFLYYEDMKENPKEEIKKIIRFLEKNLNDEILDRIIHHTSFEVMKDNPLVNYTHLPTTVMDHSKSPFMRKGTAGDWKNYFTVAQNEKFDAIYETEMSKTALQFRTEI

SEQ ID NO: 16144 - protein, 155 aa, Homo sapiens
MLSPKDILRKDLKLVHGYPMTCAFASNWEKIEQFHSRPDDIVIATYPKSGTTWVSEIIDMILNDGDIEKCKRGFITEKVPMLEMTLPGLRTSGIEQLEKNPSPRIVKTHLPTDLLPKSFWENNCKMIYLARNAKDVSVSYYHFDLMNNLQPFPGT

SEQ ID NO: 16145 - protein, 212 aa, Homo sapiens
MDPVVLSYMDSLLRQSDVSLLDPPSWLNDHIIGFAFEYFANSQFHDCSDHVSFISPEVTQFIKCTSNPAEIAMFLEPLDLPNKRVVFLAINDNSNQAAGGTHWSLLVYLQDKNSFFHYDSHSRSNSVHAKQVAEKLEAFLGRKGDKLAFVEEKAPAQQNSYDCGMYVICNTEALCQNFFRQQTESLLQLLTPAYITKKRGEWKDLITTLAKK

SEQ ID NO: 16146 - protein, 212 aa, Homo sapiens; identical to SEQ ID NO: 16145

SEQ ID NO: 16147 - protein, 212 aa, Homo sapiens; identical to SEQ ID NO: 16145

SEQ ID NO: 16148 - protein, 212 aa, Homo sapiens; identical to SEQ ID NO: 16145

SEQ ID NO: 16149 - protein, 555 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVSMISRTCVDYL

SEQ ID NO: 16150 - protein, 575 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 16151 - protein, 544 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFHHVSVYPKKELPLFIHFTAGFCSSTAMIAILTHQFPEIMGIFAKAVLGLWCPQPWASSGFEENTQDLKSEDLGLSSG

SEQ ID NO: 16152 - protein, 229 aa, Homo sapiens
MSPFLFRDDMKDLTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQL

SEQ ID NO: 16153 - protein, 321 aa, Homo sapiens
MGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKVEIYPFSPQLNIKAVDNSAISKYPANMY

SEQ ID NO: 16154 - protein, 538 aa, Homo sapiens
MADRGGVGEAAAVGASPASVPGLNPTLGWRERLRAGLAGTGASLWFVAGLGLLYALRIPLRLCENLAAGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVSMISRTCVDYL

SEQ ID NO: 16155 - protein, 555 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVVGVKTQKENAD

SEQ ID NO: 16156 - protein, 392 aa, Homo sapiens
MNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 16157 - protein, 325 aa, Homo sapiens
MGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDYLLEMKSLILPPEHILKRGDSEAIAYAFFHLQHWKRIEGALNLLQCTWEGTFHHVSVYPKKELPLFIHFTAGFCSSTAMIAILTHQFPEIMGIFAKAVLGLWCPQPWASSGFEENTQDLKSEDLGLSSG

SEQ ID NO: 16158 - protein, 287 aa, Homo sapiens
  MOD_RES (1)..(1): Any amino acid
XISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDYLLEMKSLILPPEHILKRGDSEAIAYAFFHLQHWKRIEGALNLLQCTWEGTFHHVSVYPKKELPLFIHFTAGFCSSTAMIAILTHQFPEIMGIFAKA

SEQ ID NO: 16159 - protein, 558 aa, Homo sapiens
MADRGGVGEAAAVGASPASVPGLNPTLGWRERLRAGLAGTGASLWFVAGLGLLYALRIPLRLCENLAAGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 16160 - protein, 499 aa, Homo sapiens
MSPFLFRDDMKDLTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVSMISRTCVDYL

SEQ ID NO: 16161 - protein, 401 aa, Homo sapiens [sequence omitted]

SEQ ID NO: 16162 - protein, 510 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRSCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 16163 - protein, 147 aa, Homo sapiens
MGSQGSGGVPLVQAPYTVLLLPLGTSRQDPGAQSFFLWLRRMQALEREQDALWQGLELLQHGQAWFEDHLREAQRQQLHLGALGENFLTDLHSEPGRPPLAQIQKVNICLQNLIHEKLSRQQKGVTQPKEEMAQRGCTKGPRGPTRV

SEQ ID NO: 16164 - protein, 178 aa, Homo sapiens
MGSQGSGGVPLVQAPYTVLLLPLGTSRQDPGAQSFFLWLRRMQALEREQDALWQGLELLQHGQAWFEDHLREAQRQQLHLGALGENFLTDLHSEPGRPPLAQIQKVNICLQNLIHEKFSPSPLNKASSCTTQDSKERRREQNLWQQQELSRQQKGVTQPKEEMAQRGCTKGPRGPTRV

SEQ ID NO: 16165 - protein, 147 aa, Homo sapiens; identical to SEQ ID NO: 16163

SEQ ID NO: 16166 - protein, 148 aa, Homo sapiens
MGSQGSGGVPLVQAPYTVLLLPLGTSRQDPGAQSFFLWLRRMQALEREQDALWQGLELLQHGQAWFEDHLREAQRQQLHLGALGENFLTDLHSEPGRPPLAQIQKVNICLQNLIHEKELSRQQKGVTQPKEEMAQRGCTKGPRGPTRV

SEQ ID NO: 16167 - protein, 147 aa, Homo sapiens; identical to SEQ ID NO: 16163

SEQ ID NO: 16168 - protein, 147 aa, Homo sapiens; identical to SEQ ID NO: 16163

SEQ ID NO: 16169 - protein, 147 aa, Homo sapiens; identical to SEQ ID NO: 16163

SEQ ID NO: 16170 - protein, 178 aa, Homo sapiens; identical to SEQ ID NO: 16164

SEQ ID NO: 16171 - protein, 178 aa, Homo sapiens; identical to SEQ ID NO: 16164

SEQ ID NO: 16172 - protein, 178 aa, Homo sapiens; identical to SEQ ID NO: 16164

SEQ ID NO: 16173 - protein, 147 aa, Homo sapiens; identical to SEQ ID NO: 16163

SEQ ID NO: 16174 - protein, 178 aa, Homo sapiens; identical to SEQ ID NO: 16164

SEQ ID NO: 16175 - protein, 148 aa, Homo sapiens; identical to SEQ ID NO: 16166

SEQ ID NO: 16176 - protein, 148 aa, Homo sapiens; identical to SEQ ID NO: 16166

SEQ ID NO: 16177 - protein, 148 aa, Homo sapiens; identical to SEQ ID NO: 16166

SEQ ID NO: 16178 - protein, 148 aa, Homo sapiens; identical to SEQ ID NO: 16166

SEQ ID NO: 16179 - protein, 148 aa, Homo sapiens; identical to SEQ ID NO: 16166

SEQ ID NO: 16180 - protein, 32 aa, Homo sapiens
MAAAAAGPAASQRFFQSFSDALIDQDPQAALE

SEQ ID NO: 16181 - protein, 32 aa, Homo sapiens; identical to SEQ ID NO: 16180

SEQ ID NO: 16182 - protein, 1661 aa, Homo sapiens
MEAPAAEPPVRGCGPQPAPAPAPAPERKKSHRAPSPARPKDVAGWSLAKGRRGPGPGSAVACSAAFSSRPDKKGRAVAPGARGAGVRVAGVRTGVRAKGRPRSGAGPRPPPPPPSLTDSSSEVSDCASEEARLLGLELALSSDAESAAGGPAGVRTGQPAQPAPSAQQPPRPPASPDEPSVAASSVGSSRLPLSASLAFSDLTEEMLDCGPSGLVRELEELRSENDYLKDEIEELRAEMLEMRDVYMEEDVYQLQELRQQLDQASKTCRILQYRLRKAERRSLRAAQTGQVDGELIRGLEQDVKVSKDISMRLHKELEVVEKKRARLEEENEELRQRLIETELAKQVLQTELERPREHSLKKRGTRSLGKADKKTLVQEDSADLKCQLHFAKEESALMCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAELEDQNKLLLNELAKFRSEHELDVALSEDSCSVLSEPSQEELAAAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQLQKAADPWVLKHSELEKQDNSWKETRSEKIHDKEAVSEVELGGNGLKRTKSVSSMSEFESLLDCSPYLAGGDARGKKLPNNPAFGFVSSEPGDPEKDTKEKPGLSSRDCNHLGALACQDPPGRQMQRSYTAPDKTGIRVYYSPPVARRLGVPVVHDKEGKIIIEPGFLFTTAKPKESAEADGLAESSYGRWLCNFSRQRLDGGSAGSPSAAGPGFPAALHDFEMSGNMSDDMKEITNCVRQAMRSGSLERKVKSTSSQTVGLASVGTQTIRTVSVGLQTDPPRSSLHGKAWSPRSSSLVSVRSKQISSSLDKVHSRIERPCCSPKYGSPKLQRRSVSKLDSSKDRSLWNLHQGKQNGSAWARSTTTRDSPVLRNINDGLSSLFSVVEHSGSTESVWKLGMSETRAKPEPPKYGIVQEFFRNVCGRAPSPTSSAGEEGTKKPEPLSPASYHQPEGVARILNKKAAKLGSSEEVRLTMLPQVGKDGVLRDGDGAVVLPNEDAVCDCSTQSLTSCFARSSRSAIRHSPSKCRLHPSESSWGGEERALPPSE

SEQ ID NO: 16183 - protein, 1016 aa, Homo sapiens
MLEMRDVYMEEDVYQLQELRQQLDQASKTCRILQYRLRKAERRSLRAAQTGQVDGELIRGLEQDVKVSKDISMRLHKELEVVEKKRARLEEENEELRQRLIETELAKQVLQTELERPREHSLKKRGTRSLGKADKKTLVQEDSADLKCQLHFAKEESALMCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAELEDQNKLLLNELAKFRSEHELDVALSEDSCSVLSEPSQEELAAAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQLQKAADPWVLKHSELEKQDNSWKETRSEKIHDKEAVSEVELGGNGLKRTKSVSSMSEFESLLDCSPYLAGGDARGKKLPNNPAFGFVSSEPGDPEKDTKEKPGLSSRDCNHLGALACQDPPGSQKLPFLLILAPPQPPPIL

SEQ ID NO: 16184 - protein, 1423 aa, Homo sapiens
MLEMRDVYMEEDVYQLQELRQQLDQASKTCRILQYRLRKAERRSLRAAQTGQVDGELIRGLEQDVKVSKDISMRLHKELEVVEKKRARLEEENEELRQRLIETELAKQVLQTELERPREHSLKKRGTRSLGKADKKTLVQEDSADLKCQLHFAKEESALMCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAELEDQNKLLLNELAKFRSEHELDVALSEDSCSVLSEPSQEELAAAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQLQKAADPWVLKHSELEKQDNSWKETRSEKIHDKEAVSEVELGGNGLKRTKSVSSMSEFESLLDCSPYLAGGDARGKKLPNNPAFGFVSSEPGDPEKDTKEKPGLSSRDCNHLGALACQDPPGRQMQRSYTAPDKTGIRVYYSPPVARRLGVPVVHDKEGKIIIEPGFLFTTAKPKESAEADGLAESSYGRWLCNFSRQRLDGGSAGSPSAAGPGFPAALHDFEMSGNMSDDMKEITNCVRQAMRSGSLERKVKSTSSQTVGLASVGTQTIRTVSVGLQTDPPRSSLHGKAWSPRSSSLVSVRSKQISSSLDKVHSRIERPCCSPKYGSPKLQRRSVSKLDSSKDRSLWNLHQGKQNGSAWARSTTTRDSPVLRNINDGLSSLFSVVEHSGSTESVWKLGMSETRAKPEPPKYGIVQEFFRNVCGRAPSPTSSAGEEGTKKPEPLSPASYHQPEGVARILNKKAAKLGSSEEVRLTMLPQVGKDGVLRDGDGAVVLPNEDAVCDCSTQSLTSCFARSSRSAIRHSPSKCRLHPSESSWGGEERALPPSE

SEQ ID NO: 16185 - protein, 1264 aa, Homo sapiens
MCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAELEDQNKLLLNELAKFRSEHELDVALSEDSCSVLSEPSQEELAAAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQLQKAADPWVLKHSELEKQDNSWKETRSEKIHDKEAVSEVELGGNGLKRTKSVSSMSEFESLLDCSPYLAGGDARGKKLPNNPAFGFVSSEPGDPEKDTKEKPGLSSRDCNHLGALACQDPPGRQMQRSYTAPDKTGIRVYYSPPVARRLGVPVVHDKEGKIIIEPGFLFTTAKPKESAEADGLAESSYGRWLCNFSRQRLDGGSAGSPSAAGPGFPAALHDFEMSGNMSDDMKEITNCVRQAMRSGSLERKVKSTSSQTVGLASVGTQTIRTVSVGLQTDPPRSSLHGKAWSPRSSSLVSVRSKQISSSLDKVHSRIERPCCSPKYGSPKLQRRSVSKLDSSKDRSLWNLHQGKQNGSAWARSTTTRDSPVLRNINDGLSSLFSVVEHSGSTESVWKLGMSETRAKPEPPKYGIVQEFFRNVCGRAPSPTSSAGEEGTKKPEPLSPASYHQPEGVARILNKKAAKLGSSEEVRLTMLPQVGKDGVLRDGDGAVVLPNEDAVCDCSTQSLTSCFARSSRSAIRHSPSKCRLHPSESSWGGEERALPPSE

SEQ ID NO: 16186 - protein, 78 aa, Homo sapiens
MGSGLPLVLLLTLLGSSHGTGPGMTLQLKLKESFLTSSSYESSFLELLEKLCLLLHLPSGTSVTLHHARSQHHVVCNT

SEQ ID NO: 16187 - protein, 229 aa, Homo sapiens
MPAAGPPLLLLGTPGSGKTALLFAAALEAAGEGQGPVLFLTRRPLQSMPRGTGTTLDPMRLQKIRFQYPPSTRELFRLLCSAHEAPGPAPSLLLLDGLEEYLAEDPEPQEAAYLIALLLDTAAHFSHRLGPGRDCGLMVALQTQEEAGSGDVLHLALLQRYFPAQCWLQPDAPGPGEHGLRACLEPGGLGPRTEWWVTFRSDGEMMIAPWPTQAGDPSSGKGSSSGGQP

SEQ ID NO: 16188 - protein, 900 aa, Homo sapiens
MSSKESCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASDVKPKAEGQASENKWSHLLVQREKMKELKKGRNSKFRDNSEKCVLEKWKRNQFSQDYNSNKIIKEPLGSRRQKISFKIPIKSRDTLQKLVEENVFNIDSNNSKTKQEEREYLESSQVSLNVTRQKTEHLLSDFTYKRTVHEWKRKHHYDHQESNDSHSRENLTQSFEAPCCSVSSESIQDADQEMQIVEELHAARVGKSVDLPGELMSMEIDLEDDVHSSSANNTSDRKLLIVIDTNILMNHLKFVRILKTTEVPGFDKLVLIIPWVVMQELDRMKEGKLLKRAQHKAIPAVHFINDSLKNQDRKLWGQSIQLASQKHYGLSDENNDDRVLKCCLQHQELFPCSFVILCTDDRNLRNKGLISGVKSLSKEELSAELLHLSLNTDVCHQPCIPKQQLKAETTPLKESYKEESTNSGLSILLESIVSDLEKSLGTGLSSILETEMKIAFGNLWMEILYLKPPWTLLHLLQCFKKHWLAVFGLVMEKNLLLTIESLYKNLRKANKAVDFTTVKFLLQDSRSLLHAFSTRSNYDGILPQTFAQVNNLLQTFAEVKTKLKPNSSENTVTKKQEGTSLKNSHNQEITVFSSSHLPQPSRHQEIWSILESVWITIYQNSTDVFQRLGSNSALTTSNIASFEEAFICLQKLMAAVRDILEGIQRILAPNSNYQDVETLYNFLIKYEVNKNVKFTAQEIYDCVSQTEYREKLTIGCRQLVEMEYTMQQCNASVYMEAKNRGWCEDMLNYRI

SEQ ID NO: 16189 - protein, 900 aa, Homo sapiens; identical to SEQ ID NO: 16188

SEQ ID NO: 16190 - protein, 160 aa, Homo sapiens
MSSKESCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASDV

SEQ ID NO: 16191 - protein, 514 aa, Homo sapiens
MMNFLRRRLSDSSLFSSLSQAVKQTAASAGLVDAPGAAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGGPGQPQGMQPPGKVLPPRRLPPGPSLPPSSSSSSSSSSSAPQRPGGPTTHGDAPSSSSSLAEAQPPLAAPPQKPQPHPQLNKSQSLTNAFSFSESSFFRSSANEDEAKAETIRSLRKSFASLFSD

SEQ ID NO: 16192 - protein, 242 aa, Homo sapiens
MAGKLKPLNVEAPEATEEAEGQAKSLKTEDLLAMVIKLQKEGSLEPQIEDLISRINDLQQAKKKSSEELRETHSLWEALHRELDSLNGEKVHLEEVLGKKQEALRILQMHCQEKESEAQRLDVRGQLEDLMGQHKDLWEFHMLEQRLAREIRALERSKEQLLSERRLVRAKLREVERRLHSPPEVEGAMAVNDGLKAELEIFGEQVRSAPEVGAGEGEAGPELPRARDEEDPEPPVAAPDAL

SEQ ID NO: 16193 - protein, 88 aa, Homo sapiens
MDDADPEERNYDNMLKMLSDLNKDLEKLLEEMEKISVQATWMAYDMVVMRTNPTLAESMRRLEDAFVNCKEEMEKNWQELLHETKQRL

SEQ ID NO: 16194 - protein, 313 aa, Homo sapiens
MLLLADMDVVNQLVAGGQFRVVKEPLGFVKVLQWVFAIFAFATCGSYSGELQLSVDCANKTESDLSIEVEFEYPFRLHQVYFDAPTCRGGTTKVFLVGDYSSSAEFFVTVAVFAFLYSMGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 16195 - protein, 390 aa, Homo sapiens
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKQATTVELFLFHLTSG

SEQ ID NO: 16196 - protein, 610 aa, Homo sapiens
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRNVKIKTGEWFYEERAKKFPTGGKHETVGGQLLQSYQKLSKISVVPPTPPPVSESQCSRSPGRLQEFGQFRGFNKSVENLFLSLATHVKKLSKSQNDMTSEKHLLATGPRQCVGQTERRSQSDTAVNVTTRKVSAPDILKPLNQEDPKCSTNPILKQQNLPSSPAPSTIFSGGFRHGSLISIDSTCTEMGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIIPLATWDFEDSTTQSFRWHPLRAKAEKYEDSVPQSNGELTVRAKLVLPSRPRKLQEAQEGTDQPSLHGQLCLVVLGAKNLPVRPDGTLNSFVKGCLTLPDQQKLRLKSPVLRKQACPQWKHSFVFSGVTPAQLRQSSLELTVWDQALFGMNDRLLGGTRLGSKGDTAVGGDACSLSKLQWQKVLSSPNLWTDMTLVLH

SEQ ID NO: 16197 - protein, 542 aa, Homo sapiens
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRNVKIKTGEWFYEERAKKFPTGGKHETVGGQLLQSYQKLSKISVVPPTPPPVSESQCSRSPGRKVSAPDILKPLNQEDPKCSTNPILKQQNLPSSPAPSTIFSGGFRHGSLISIDSTCTEMGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIIPLATWDFEDSTTQSFRWHPLRAKAEKYEDSVPQSNGELTVRAKLVLPSRPRKLQEAQEGTDQPSLHGQLCLVVLGAKNLPVRPDGTLNSFVKGCLTLPDQQKLRLKSPVLRKQACPQWKHSFVFSGVTPAQLRQSSLELTVWDQALFGMNDRLLGGTRLGSKGDTAVGGDACSLSKLQWQKVLSSPNLWTDMTLVLH

SEQ ID NO: 16198 - protein, 336 aa, Homo sapiens
MRNEPRNFQLEGSLISIDSTCTEMGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIIPLATWDFEDSTTQSFRWHPLRAKAEKYEDSVPQSNGELTVRAKLVLPSRPRKLQEAQEGTDQPSLHGQLCLVVLGAKNLPVRPDGTLNSFVKGCLTLPDQQKLRLKSPVLRKQACPQWKHSFVFSGVTPAQLRQSSLELTVWDQALFGMNDRLLGGTRLGSKGDTAVGGDACSLSKLQWQKVLSSPNLWTDMTLVLH

SEQ ID NO: 16199 - protein, 567 aa, Homo sapiens
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRNVKIKTGEWFYEERAKKFPTGGKHETVGGQLLQSYQKLSKISVVPPTPPPVSESQCSRSPGRLQEFGQFRGFNKSVENLFLSLATHVKKLSKSQNDMTSEKHLLATGPRQCVGQTERRSQSDTAVNVTTRKVSAPDILKPLNQEDPKCSTNPILKQQNLPSSPAPSTIFSGGFRHGSLISIDSTCTEMGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIIPLATWDFEDSTTQSFRWHPLRAKAEKYEDSVPQSNGELTVRAKLVLPSRPRKLQEAQEGTDQPSLHGQLCLVVLGAKNLPVRPDGTLNSFVKGCLTLPDQQKLRLKSPVLRKQACPQWRHSCWRGCMLTIEAPVAESPFQPQSMDRHDSCPALT

SEQ ID NO: 16200 - protein, 730 aa, Homo sapiens
MSKNSEFINLSFLLDHEKEMILGVLKRDEYLKKVEDKRIRKLKNELLEAKRRSGKTQQEASRVCVHCHRNLGLIFDRGDPCQACSLRVCRECRVAGPNGSWKCTVCDKIAQLRIITGEWFFEEKAKRFKQVNVLGTDVVRQSILRRSPGAEEVQSQEQTRQDAEKSDTSPVAGKKASHDGPKRKGFLLSKFRSATRGEIITPKTDTGRSYSLDLDGQHFRSLKSPPGSDRGSTGSSDLNDQEPGPRTPKSSRSNGVTPGTQSSPAPSTRTVTSVISREYGFENSMDLAAIEGTSQELTKSHRRNTSGTPSIAVSGTSLSSDQSRSELDLSESFTEDSEDTVSIRSKSVPGALDKDSLEETEESIDALVSSQLSTNTHRLASGLSTTSLNSMMSVYSETGDYGNVKVSGEILLHISYCYKTGGLYIFVKNCRNLAIGDEKKQRTDAYVKSYLLPDKSRNNKRKTKIRTGTNPEFNETLKYTISHTQLETRTLQLSVWHYDRFGRNSFLGEVEIPFDSWNFENPTDEWFVLQPKVEFAPDIGLQYKGELTVVLRYIPPEENLMLPPEQLQGNKTFKKGKKKESPVISGGILEVFIKEAKNLTAVKSGGTSDSFVKGYLLPDDSKATKHKTLVIKKSVNPQWNHTFMFSGIHPQDIKNVCLELTIWDKEAFSSNIFLGGVRLNSGSGVSHGKNVDWMDSQGEEQRLWQKMANNPGTPFEGVLMLRSSMGKCRL

SEQ ID NO: 16201 - protein, 730 aa, Homo sapiens; identical to SEQ ID NO: 16200

SEQ ID NO: 16202 - protein, 752 aa, Homo sapiens
MSKNSEFINLSFLLDHEKEMILGVLKRDEYLKKVEDKRIRKLKNELLEAKRRSGKTQQEASRVCVHCHRNLGLIFDRGDPCQACSLRVCRECRVAGPNGSWKCTVCDKIAQLRIITGEWFFEEKAKRFKQVNVLGTDVVRQSILRRSPGAEEVQSQEQTRQDAEKSDTSPVAGKKASHDGPKRKGFLLSKFRSATRGEIITPKTDTGRSYSLDLDGQHFRSLKSPPGSDRGSTGSSDLNDQEPGPRTPKSSRSNGVTPGTQSSPAPSTRTVTSVISREYGFENSMDLAAIEGTSQELTKSHRRNTSGTPSIAVSGTSLSSDQSRSELDLSESFTEDSEDTVSIRSKSVPGALDKDSLEETEESIDALVSSQLSTNTHRLASGLSTSSQAGSDRKWTYLNVPDADSDTTSLNSMMSVYSETGDYGNVKVSGEILLHISYCYKTGGLYIFVKNCRNLAIGDEKKQRTDAYVKSYLLPDKSRNNKRKTKIRTGTNPEFNETLKYTISHTQLETRTLQLSVWHYDRFGRNSFLGEVEIPFDSWNFENPTDEWFVLQPKVEFAPDIGLQYKGELTVVLRYIPPEENLMLPPEQLQGNKTFKKGKKKESPVISGGILEVFIKEAKNLTAVKSGGTSDSFVKGYLLPDDSKATKHKTLVIKKSVNPQWNHTFMFSGIHPQDIKNVCLELTIWDKEAFSSNIFLGGVRLNSGSGVSHGKNVDWMDSQGEEQRLWQKMANNPGTPFEGVLMLRSSMGKCRL

SEQ ID NO: 16203 - protein, 1253 aa, Homo sapiens
MLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAEALRREALGLEQLRARLEDALLRMREEYGIQAEERQRVIDCLEDEKATLTLAMADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSPKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 16204 - protein, 1252 aa, Homo sapiens
MLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAALRREALGLEQLRARLEDALLRMREEYGIQAEERQRVIDCLEDEKATLTLAMADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSPKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 16205 - protein, 1564 aa, Homo sapiens
MLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAALRREALGLEQLRARLEDALLRMREEYGIQAEERQRVIDCLEDEKATLTLAMADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSPKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEVSAGGDLSQAASPTGASRSVRHVTLGPGQSPLSREVIFLGPAPACPEAWGSPEPGPAESSADMDGSGRHSTFGCRQFHAEKEIIFQGPISAAGKVGDYFATEESVGTQTSVRQLQLGPKEGFSGQIQFTAPLSDKVELGVIGDSVHMEGLPGSSTSIRHISIGPQRHQTTQQIVYHGLVPQLGESGDSESTVHGEGSADVHQATHSHTSGRQTVMTEKSTFQSVVSESPQEDSAEDTSGAEMTSGVSRSFRHIRLGPTETETSEHIAIRGPVSRTFVLAGSADSPELGKLADSSRTLRHIAPGPKETSFTFQMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 16206 - protein, 188 aa, Homo sapiens
MNGDDAFVRRPRVGSQIPEKMQKAFDDIAKYFSEKEWEKMKASEKIIYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 16207 - protein, 294 aa, Homo sapiens
MKDRLQELKQRTKEIELSRDSHVSTTETEEQGVFLQQAVIYEREPVAERHLHEIQKLQESINNLADNVQKFGQQQKSLVASMRRFSLLKRESTITKEIKIQAEYINRSLNDLVKEVKKSEVENGPSSVVTRILKSQHAAMFRHFQQIMFIYNDTIAAKQEKCKTFILRQLEVAGKEMSEEDVNDMLHQGKWEVFNESLLTEINITKAQLSEIEQRHKELVNLENQIKDLRDLFIQISLLVEEQGESINNIEMTVNSTKEYVNNTKEKFGLAVKYKKRNPCRVLCCWCCPCCSSK

SEQ ID NO: 16208 - protein, 130 aa, Homo sapiens
METVVTTLPREGGVGPSRKMLLLLLLLGPGSGLSAVVSQHPSRVICKSGTSVNIECRSLDFQATTMFWYRQLRKQSLMLMATSNEGSEVTYEQGVKKDKFPINHPNLTFSALTVTSAHPEDSSFYICSAR

SEQ ID NO: 16209 - protein, 114 aa, Homo sapiens
TGTRLLGWVALCLLAAGCFHAKVTQTPGYLVKGKGRKTKMYCTPKNGHTFVCWYQQNQNKEFMFLISFQNEQVLQEMEMHKKRFSSQCPKNPPCSLAILSSEPGDTALYLCATS

SEQ ID NO: 16210 - protein, 112 aa, Homo sapiens
MTIRFLRQVAFYFLEAGLKEAEIYQTPRHRVIGAGKKITLECSQTMGHDKMYWSRSRNGITPHPPFLWVNSTEKGDLCSESTVSRIRIERFPLTLESASPSHTSQYLCASSE

SEQ ID NO: 16211 - protein, 174 aa, Homo sapiens
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPVSDEALGLRVV

SEQ ID NO: 16212 - protein, 338 aa, Homo sapiens
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMIESRSVTQAGVQWQDLGSLQPPPPGFKRFSSLSLLSSWNYRRILEPRRRTPLSCSRTPPCRVAGMGRRTSSITLICGR

SEQ ID NO: 16213 - protein, 311 aa, Homo sapiens
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMEDSGAEKENTSVLQQNPSLSGSRNGEENIIDNPYLRPVKKPKIRRKKPDTF

SEQ ID NO: 16214 - protein, 338 aa, Homo sapiens; identical to SEQ ID NO: 16212

SEQ ID NO: 16215 - protein, 264 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 16216 - protein, 457 aa, Homo sapiens
MEFLLGNPFSTPVGQCLEKATDGSLQSEDWTLNMEICDIINETEEGPKDAIRALKKRLNGNRNYREVMLALTAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 16217 - protein, 507 aa, Homo sapiens
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 16218 - protein, 462 aa, Homo sapiens
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 16219 - protein, 483 aa, Homo sapiens
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEELKRKGVEFPMADLDALSPIHTPQRIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGTFLSSAQKRGRGGESDLEPIDSWLITQGMIPVAQPSVMDDIEVWLRTDLKGDDLEEGVTSEEFDKFLEERAKAAEMVPDLPSPPMEAPAPASNPSGRKKPERSEDALFAL

SEQ ID NO: 16220 - protein, 277 aa, Homo sapiens
MEFLLGNPFSTPVGQCLEKATDGSLQSEDWTLNMEICDIINETEEGPKDAIRALKKRLNGNRNYREVMLALTAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERWEPDFFFFFFLEKIVAITEGFLS

SEQ ID NO: 16221 - protein, 389 aa, Homo sapiens
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGKGDDLEEGVTSEEFDKFLEERAKAAEMVPDLPSPPMEAPAPASNPSGRKKPERSEDALFAL

SEQ ID NO: 16222 - protein, 388 aa, Homo sapiens
MEFLLGNPFSTPVGQCLEKATDGSLQSEDWTLNMEICDIINETEEGPKDAIRALKKRLNGNRNYREVMLALTIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGTFLSSAQKRGRGGESDLEPIDSWLITQGMIPVAQPSVMDDIEVWLRTDLKGDDLEEGVTSEEFDKFLEERAKAAEMVPDLPSPPMEAPAPASNPSGRKKPERSEDALFAL

SEQ ID NO: 16223 - protein, 457 aa, Homo sapiens; identical to SEQ ID NO: 16216

SEQ ID NO: 16224 - protein, 856 aa, Homo sapiens
  MOD_RES (1)..(1): Any amino acid
XCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 16225 - protein, 893 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQYMNKHGIVHRALSPHNILLDRKGHIKLAKFGLYHMTAHGDDVDFPIGYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRPTPDQLMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 16226 - protein, 830 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVRYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRPTPDQLMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 16227 - protein, 854 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQYMNKHGIVHRALSPHNILLDRKGHIKLAKFGLYHMTAHGDDVDFPIGYPSYLAPEGRKLFQSLDISERLKFLLTLDCVDDTLIVLAEEHGCLDIIKELPETVIDLLNKCLTFHPSKRPTPDQLMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 16228 - protein, 893 aa, Homo sapiens; identical to SEQ ID NO: 16225

SEQ ID NO: 16229 - protein, 893 aa, Homo sapiens; identical to SEQ ID NO: 16225

SEQ ID NO: 16230 - protein, 68 aa, Homo sapiens
MFPLKDAEMGAFTFFASALPHDVCGSNGLPLTPNSIKILGRFQILKTITHPRLCQYVDISRGKHERLV

SEQ ID NO: 16231 - protein, 159 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQYMNKHGIVHRALSPHNILLDRKGHIKLAKFGLYHMTAHGDDVDFPIGYPSYLAP

SEQ ID NO: 16232 - protein, 105 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQ

SEQ ID NO: 16233 - protein, 250 aa, Homo sapiens
MEMDGDPYNLPAQGQGNIIITKYEQGHRAGAAVDLGHEQVDVRKYTNNLGIVHEMELPHVSALEVKQRRKESKRTNKWQKMLADWTKYRSTKKLSQRVYKVIPLAVRGRAWSLLLDIDRIKSQNPGKYKVMKEKGKRSSRIIHCIQLDVSHTLQKHMMFIQRFGVKQQELCDILVAYSAYNPEVGYHRDLSRITAILLLCLPEEDAFWALTQLLAGERHSLWYSTAQILPGSRGSYRTRSRCCTSPSQRS

SEQ ID NO: 16234 - protein, 150 aa, Homo sapiens
MGHLDKEGLCTQGSSFSWLLRVLNDGISLGLTPCLWDMYLLEGEQMLMLITSIAFKVQRSLYEETNKETWGPATPRALKGTGRARPICESLHSSLQALTASESSRGPSLLQTPPRVPGQQALSRGDKGISVSLSLPSLPSRRGRCGRIIG

SEQ ID NO: 16235 - protein, 761 aa, Homo sapiens
MRQDKLTGSLRRGGRCLKRQGGGVGTILSNVLKKRSCISRTAPRLLCTLEPGVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 16236 - protein, 817 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGDVVTGSDAQVSVPVQTLTDLQGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 16237 - protein, 775 aa, Homo sapiens
MVGPEDAGACSGRNPKLLPVPAPDPVGQDRKVIRATGGFGGGVGAVEPPEEADEEEEADEEEETPPRQLLQRYLAAAGEQLEPGLCYCPLPAGQAGAPPPSAAPRSDACLLGSGSKHRGAEVADGRAPRHEGMTNGDSGFLPGRDCRDLEEARGLARAGGRESRRRRPYGRLRLEGPGDEDADGAGSPSDWASPLEDPLRSCCLVAADAQEPEGAGSDSGDSPASSCSSSEDSEQRGVGAGGPEEGAPPATSAERTNGGAEPRLGFSDIHFNSRNTFQVSRGQSARDHLPPAGPPVPLPAAEQGPAGASARARRSGGFADFFTRNLFPKRTKELKSVVHSAPGWKLFGKVPPRENLQKTSKIIQQEYEARTGRTCKPPPQSSRRKNFEFEPLSTTALILEDRPSNLPAKSVEEALRHRQEYDEMVAEAKKREIKEAHKRKRIMKERFKQEENIASAMVIWINEILPNWEVMRSTRRVRELWWQGLPPSVRGKVWSLAVGNELNITPELYEIFLSRAKERWKSFSETSSENDTEGVSVADREASLELIKLDISRTFPSLYIFQKGGPYHDVLHSILGAYTCYRPDVGYVQGMSFIAAVLILNLEEADAFIAFANLLNKPCQLAFFRVDHSMMLKYFATFEVFFEENLSKLFLHFKSYSLTPDIYLIDWIFTLYSKSLPLDLACRVWDVFCRDGEEFLFRTGLGILRLYEDILLQMDFIHIAQFLTKLPEDITSEKLFSCIAAIQMQNSTKKWTQVFASVMKDIKEGDKNSSPALKS

SEQ ID NO: 16238 - protein, 275 aa, Homo sapiens
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 16239 - protein, 400 aa, Homo sapiens
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 16240 - protein, 219 aa, Homo sapiens
MSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 16241 - protein, 693 aa, Homo sapiens
MTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKSSTFPRTGYDSVKLYSPTSKALTRSDDVSVCSVSSLGTELSTTLSVSNEDILDLVVTSSSSAIVTLENDDDPQFTNVTLSSIKETRGLHQQDCVHEAEEGSKLKILGPFSNFFARNLLARKQSARLDKHNDLGWKLFGKAPLRENAQKDSKRIQKEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 16242 - protein, 56 aa, Homo sapiens
MTDGKLSTSTNGVAFMGILDGRPGNPLQNLQHVNLKAPRLLSAPEYGPKLKLRALE

SEQ ID NO: 16243 - protein, 127 aa, Homo sapiens
MTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKS

SEQ ID NO: 16244 - protein, 340 aa, Homo sapiens
MWCSRKVRDLWWQGIPPSVRGKVWSLAIGNELNITHELFDICLARAKERWRSLSTGGSEVENEDAGFSAADREASLELIKLDISRTFPNLCIFQQVLIFVDFRVGLQKSFQKRKERESTKLQQLWSWCLGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 16245 - protein, 693 aa, Homo sapiens; identical to SEQ ID NO: 16241

SEQ ID NO: 16246 - protein, 413 aa, Homo sapiens
MEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 16247 - protein, 767 aa, Homo sapiens
MSLGRLLRRASSKASDLLTLTPGGSGSGSPSVLDGEIIYSKNNVCVHPPEGLQGLGEHHPGYLCLYMEKDEMLGATLILAWVPNSRIQRQDEEALRYITPESSPVRKAPRPRGRRTRSSGASHQPSPTELRPTLTPKDEDILVVAQSVPDRMLASPAPEDEEKLAQGLGVDGAQPASQPACSPSGILSTVSPQDVTEEGREPRPEAGEEDGSLELSAEGVSRDSSFDSDSDTFSSPFCLSPISAALAESRGSVFLESDSSPPSSSDAGLRFPDSNGLLQTPRWDEPQRVCALEQICGVFRVDLGHMRSLRLFFSDEACTSGQLVVASRESQYKVFHFHHGGLDKLSDVFQQWKYCTEMQLKDQQVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGFGFRR

SEQ ID NO: 16248 - protein, 405 aa, Homo sapiens
MKVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGFGFRR

SEQ ID NO: 16249 - protein, 648 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPDYEPDWAVISTVRPQLCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 16250 - protein, 615 aa, Homo sapiens
MEGAGYRDNDVLLHWAPVEEAGDSTQILFSKKDSSGGDSCASEEEPTFDPDYEPDWAVISTVRPQLCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 16251 - protein, 526 aa, Homo sapiens
MLQEESDLSLIIAQIVQKLKGSNLYSQLERQAWASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 16252 - protein, 461 aa, Homo sapiens
MLQEESDLSLIIAQIVQKLKGSNLYSQLERQAWGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 16253 - protein, 336 aa, Homo sapiens
MTTLSPENSLSARQSASFILVKRKPPIDKTEWDSFFDESGHLAKSRDFICVNILERGLHPFVRTEAWKFLTGYFSWQSSQDERLTVDSMRRKNYKALCQMYEKIQPLLENLHRNFTETRNNIARDIQKIYDKDPLGNVLIDKKRLEKILLLSYVCNTQAEYQQGFHEMMMLFQLMVEHDHETFWLFQFFLQKTEHSCVINIGVAKNLDMLSTLITFLDPVFAEHLKGKGAGAVQSLFPWFCFCFQRAFKSFDDVWRLWEVLLTGKPCRNFQVLVAYSMLQMVREQVLQESMGGDDILLACNNLIDLDADELISAACVVYAELIQKDVPQTLKDFFL

SEQ ID NO: 16254 - protein, 300 aa, Homo sapiens
MTTLSPENSLSARQSASFILGLHPFVRTEAWKFLTGYFSWQSSQDERLTVDSMRRKNYKALCQMYEKIQPLLENLHRNFTETRNNIARDIQKIYDKDPLGNVLIDKKRLEKILLLSYVCNTQAEYQQGFHEMMMLFQLMVEHDHETFWLFQFFLQKTEHSCVINIGVAKNLDMLSTLITFLDPVFAEHLKGKGAGAVQSLFPWFCFCFQRAFKSFDDVWRLWEVLLTGKPCRNFQVLVAYSMLQMVREQVLQESMGGDDILLACNNLIDLDADELISAACVVYAELIQKDVPQTLKDFFL

SEQ ID NO: 16255 - protein, 517 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 16256 - protein, 439 aa, Homo sapiens
MASDGARKQFWKRSNSKLPGSLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 16257 - protein, 324 aa, Homo sapiens
MPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIAFPGCGRPQIPILAVIWRDEPYPRTDEQIILRR

SEQ ID NO: 16258 - protein, 470 aa, Homo sapiens
MPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 16259 - protein, 458 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 16260 - protein, 505 aa, Homo sapiens
MAAENSKQFWKRSAKLPGSIQPVYGAQHPPLDPRLTKNFIKERSKVNTVPLKNKKASSFHEFARNTSDAWDIGDDEEEDFSSPSFQTLNSKVALATAAQVLENHSKLRVKPERSQSTTSDVPANYKVIKSSSDAQLSRNSSDTCLRNPLHKQQSLPLRPIIPLVARISDQNASGAPPMTVREKTRLEKFRQLLSSQNTDLDELRKCSWPGVPREVRPITWRLLSGYLPANTERRKLTLQRKREEYFGFIEQYYDSRNEEHHQDTYRQIHIDIPRTNPLIPLFQQPLVQEIFERILFIWAIRHPASGYVQGINDLVTPFFVVFLSEYVEEDVENFDVTNLSQDMLRSIEADSFWCMSKLLDGIQDNYTFAQPGIQKKVKALEELVSRIDEQVHNHFRRYEVEYLQFAFRWMNNLLMRELPLRCTIRLWDTYQSEPEGFSHFHLYVCAAFLIKWRKEILDEEDFQGLLMLLQNLPTIHWGNEEIGLLLAEAYRLKYMFADAPNHYRR

SEQ ID NO: 16261 - protein, 684 aa, Homo sapiens
MAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 16262 - protein, 699 aa, Homo sapiens
MAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRMSFNLPWPDRSCTERHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 16263 - protein, 562 aa, Homo sapiens
MGWYFRLARTEHYSQRLPAVYWDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRMSFNLPWPDRSCTERHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 16264 - protein, 250 aa, Homo sapiens; identical to SEQ ID NO: 16233

SEQ ID NO: 16265 - protein, 210 aa, Homo sapiens
MEMDEDPDNLPAQGQGNIIITKYEQGHRAGAAVDLGHEQVDVRKYTNNLGIVHEMELPRVSALEVKQRRKESKRTNKWQKMLADWTKYRSTKKLSQRVCKVIPLAVRGRALSLLLDIDKIKSQNPGKYKVMKEKGKRSSRIIHCIQLDVSHTLQKHMMFIQRFGVKQQELCDILVAYSAYNPVSIPGQRYSWYLCPYSQAWVSLGGVATS

SEQ ID NO: 16266 - protein, 210 aa, Homo sapiens; identical to SEQ ID NO: 16265

SEQ ID NO: 16267 - protein, 150 aa, Homo sapiens; identical to SEQ ID NO: 16234

SEQ ID NO: 16268 - protein, 81 aa, Homo sapiens
MGHLDKEGLCTQGSSFSWLLRVLNDGISLGLTPCLWDMYLLEGEQMLMLITSIAFKVQRRPSRALEEPDPFVRASTPPCKR

SEQ ID NO: 16269 - protein, 963 aa, Homo sapiens
MPGAGARAEEGGGGGEGAAQGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDARKLISISFGDLNPFPLRQIRNRRAYHLEKVRLELTELEAIREDFLRERDTSPDKGELVSDEEEDT

SEQ ID NO: 16270 - protein, 914 aa, Homo sapiens
MPGAGARAEEGGGGGEGAAQGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDARSGTDAPTTWRKSGWS

SEQ ID NO: 16271 - protein, 924 aa, Homo sapiens
MDVLPTGGGRPGLRTELEFRGGGGEARLESQEEETIPAAPPAPRLRGAAERPRRSRDTWDGDEDTEPGEACGGRTSRTASLVSGLLNELYSCTEEEEAAGGGRGAEGRRRRRDSLDSSTEASGSDVVLGGRSGAGDSRVLQELQERPSQRHQMLYLRQKDANELKTILRELKYRIGIQSAKLLRHLKQKDRLLHKVQRNCDIVTACLQAVSQKRRVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 16272 - protein, 577 aa, Homo sapiens
MRQDKLTGSLRRGGRCLKRQGGGVGTILSNVLKKRSCISRTAPRLLCTLEPGVDTKLKFTLEPSLGQNGFQQWYDALKAVARLSTGIPKEWRRKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTAGQG

SEQ ID NO: 16273 - protein, 637 aa, Homo sapiens
MRQDKLTGSLRRGGRCLKRQGGGVGTILSNVLKKRSCISRTAPRLLCTLEPGVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSSSYKSLQMI

SEQ ID NO: 16274 - protein, 795 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 16275 - protein, 183 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVR

SEQ ID NO: 16276 - protein, 795 aa, Homo sapiens; identical to SEQ ID NO: 16274

SEQ ID NO: 16277 - protein, 88 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRS

SEQ ID NO: 16278 - protein, 1140 aa, Homo sapiens
MWLKPEEVLLKNALKLWVTQKSSCYFILQRRRGHGEGGGRLTGRLVGALDAVLDSNARVAPFRILLQVPGSQVYSPIACGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTTGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAERDWTVSLEHILASLLTEQSLVNFFEKPLDMKSKLENAKINQYNLKTFEMSHQSQSELKLSNL

SEQ ID NO: 16279 - protein, 1155 aa, Homo sapiens
MWLKPEEVLLKNALKLWVTQKSSCYFILQRRRGHGEGGGRLTGRLVGALDAVLDSNARVAPFRILLQVPGSQVYSPIACGELLNGSDVYWAIATGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTTGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAERDWTVSLEHILASLLTEQSLVNFFEKPLDMKSKLENAKINQYNLKTFEMSHQSQSELKLSNL

SEQ ID NO: 16280 - protein, 632 aa, Homo sapiens
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTELAISSESTEPSDNFEVQSLTSQRECSKTVNTEALMTVFHPQNLETLNSKMLKEKMKEQSWKILFAECGRGVSMFRTKKTRDLVVRGIPETLRGELWMLFSGAVNDMATNPDYYTEVVEQSLGTCNLATEEIERDLRRSLPEHPAFQSDTGISALRRVLTAYAYRNPKIGYCQAMNILTSVLLLYAKEEEAFWLLVAVCERMLPDYFNRRIIGSDDFMPLVRIQGQCVIGEK

SEQ ID NO: 16281 - protein, 1120 aa, Homo sapiens
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTELAISSESTEPSDNFEVQSLTSQRECSKTVNTEALMTVFHPQNLETLNSKMLKEKMKEQSWKILFAECGRGVSMFRTKKTRDLVVRGIPETLRGELWMLFSGAVNDMATNPDYYTEVVEQSLGTCNLATEEIERDLRRSLPEHPAFQSDTGISALRRVLTAYAYRNPKIGYCQAMNILTSVLLLYAKEEEAFWLLVAVCERMLPDYFNRRIIGALVDQAVFEELIRDHLPQLTEHMTDMTFFSSVSLSWFLTLFISVLPIESAVNVVDCFFYDGIKAILQLGLAILDYNLDKLLTCKDDAEAVTALNRFFDNVTNKDSPLPSNVQQGSNVSDEKTSHTRVDITDLIRESNEKYGNIRYEDIHSMRCRNRLYVIQTLEETTKQNVLRVVSQDVKLSLQELDELYVIFKKELFLSCYWCLGCPVLKHHDPSLPYLEQYQIDCQQFRALYHLLSPWAHSANKDSLALWTFRLLDENSDCLINFKEFSSAIDIMYNGSFTEKLKLLFKLHIPPAYTEVKSKDASKGDELSKEELLYFSQLHVSKPANEKEAESAKHSPEKGKGKIDIQAYLSQWQDELFKKEENIKDLPRMNQSQFIQFSKTLYNLFHEDPEEESLYQAIAVVTSLLLRMEEVGRKLHSPTSSAKGFSGTVCGSGGPSEEKTGSHLEKDPCSFREEPQWSFAFEQILASLLNEPALVRFFEKPIDVKAKLENARISQLRSRTKM

SEQ ID NO: 16282 - protein, 217 aa, Homo sapiens
FNRFFDNVTNKDSPLPSNVQQGSNVSDEKTSHTRVDITDLIRESNELRVVSQDVKLSLQELDELYVIFKKELFLSCYWCLGCPVLKHHDPSLPYLEQYQIDCQQFRALYHLLSPWAHSANKDSLALWTFRLLDENSDCLINFKEFSSAIDIMYNGSFTEKLKLLFKLHIPPAYTEVKSKDASKGDELSKEELLYFSQLHVSKPANEKEAESAKHSPE

SEQ ID NO: 16283 - protein, 1266 aa, Homo sapiens
MWVNPEEVLLANALWITERANPYFILQRRKGHAGDGGGGGGLAGLLVGTLDVVLDSSARVAPYRILYQTPDSLVYWTIACGGSRKEITEHWEWLEQNLLQTLSIFENENDITTFVRGKIQGIIAEYNKINDVKEDDDTEKFKEAIVKFHRLFGMPEEEKLVNYYSCSYWKGKVPRQGWMYLSINHLCFYSFLMGREAKLVIRWVDITQLEKNATLLLPDVIKVSTRSSEHFFSVFLNINETFKLMEQLANIAMRQLLDNEGFEQDRSLPKLKRKSPKKVSALKRDLDARAKSERYRALFRLPKDEKLDGHTDCTLWTPFNKMHILGQMFVSTNYICFTSKEENLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGAINEKATHPGYYEDLVEKSMGKYNLATEEIERDLHRSLPEHPAFQNEMGIAALRRVLTAYAFRNPNIGYCQAMNIVTSVLLLYAKEEEAFWLLVALCERMLPDYYNTRVVGALVDQGVFEELARDYVPQLYDCMQDLGVISTISLSWFLTLFLSVMPFESAVVVVDCFFYEGIKVIFQLALAVLDANVDKLLNCKDDGEAMTVLGRYLDSVTNKDSTLPPIPHLHSLLSDDVEPYPEVDIFRLIRTSYEKFGTIRADLIEQMRFKQRLKVIQTLEDTTKRNVVRTIVTETSFTIDELEELYALFKAEHLTSCYWGGSSNALDRHDPSLPYLEQYRIDFEQFKGMFALLFPWACGTHSDVLASRLFQLLDENGDSLINFREFVSGLSAACHGDLTEKLKLLYKMHVLPEPSSDQDEPDSAFEATQYFFEDITPECTHVVGLDSRSKQGADDGFVTVSLKPDKGKRANSQENRNYLRLWTPENKSKSKNAKDLPKLNQGQFIELCKTMYNMFSEDPNEQELYHATAAVTSLLLEIGEVGKLFVAQPAKEGGSGGSGPSCHQGIPGVLFPKKGPGQPYVVESVEPLPASLAPDSEEHSLGGQMEDIKLEDSSPRDNGACSSMLISDDDTKDDSSMSSYSVLSAGSHEEDKLHCEDIGEDTVLVRSGQGTAALPRSTSLDRDWAITFEQFLASLLTEPALVKYFDKPVCMMARITSAKNIRMMGKPLTSASDYEISAMSG

SEQ ID NO: 16284 - protein, 615 aa, Homo sapiens
MESMFEDDISILTQEALGPSEVWLDSPGDPSLGGDMCSASHFALITAYGDIKERLGGLERENATLRRRLKVYEIKYPLISDFGEEHGFSLYEIKDGSLLEVEKVSLQQRLNQFQHELQKNKEQEEQLGEMIQAYEKLCVEKSDLETELREMRALVETHLRQICGLEQQLRQQQGLQDAAFSNLSPPPAPAPPCTDLDLHYLALRGGSGLSHAGWPGSTPSVSDLERRRLEEALEAAQGEARGAQLREEQLQAECERLQGELKQLQETRAQDLASNQSERDMAWVKRVGDDQVNLALAYTELTEELGRLRELSSLQGRILRTLLQEQARSGGQRHSPLSQRHSPAPQCPSPSPPARAAPPCPPCQSPVPQRRSPVPPCPSPQQRRSPASPSCPSPVPQRRSPVPPSCQSPSPQRRSPVPPSCPAPQPRPPPPPPPGERTLAERAYAKPPSHHVKAGFQGRRSYSELAEGAAYAGASPPWLQAEAATLPKPRAYGSELYGPGRPLSPRRAFEGIRLRFEKQPSEEDEWAVPTSPPSPEVGTIRCASFCAGFPIPESPAATAYAHAEHAQSWPSINLLMETVGSDIRSCPLCQLGFPVGYPDDALIKHIDSHLENSKI

SEQ ID NO: 16285 - protein, 223 aa, Homo sapiens
MESMFEDDISILTQEALGPSEVWLDSPGDPSLGGDMCSASHFALITAYGDIKERLGGLERENATLRRRLKVYEIKYPLISDFGEEHGFSLYEIKDGSLLEVEKVSLQQRLNQFQHELQKNKEQEEQLGEMIQAYEKLCVEKSDLETELREMRALVETHLRQICGLEQQLRQQQGLQDAAFSNLSPPRRARAVLAVHQLADGDGGLRHPQLPPLPAGFPCRVPG

SEQ ID NO: 16286 - protein, 353 aa, Homo sapiens
MLEGQLEAREPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKIMHPSSRSLQNSGGRKSPVQASQAATLQEQTAAAGVADRSSSVLGSSEGGFLSRVQAEEFASSSPDSAERQNLPVNPPSSLEIAQAMDTKMKKEEVQEEKRHPNGKADDCRRSGFPSEFPGALHAAPSRQDMGP

SEQ ID NO: 16287 - protein, 374 aa, Homo sapiens
MKVDMANFAISSIRPHLMQQSVEYERKKFQEILERQPNSLDFVTQWLEEASEDLMTQKYKHALPVGGMAAGSGDMPRLSPVAVQNYAYLKLLKWDHLQRPFPETVLMDQSRFHELQLQLEQLTILGAVLLVTFSMAAPGISSQADFAEKLKMIVKILLTDMHLPSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILRKRWISFGNFFGSSNTDMSPWNCRTDYPMSLHIRFPKNHVIEAPMTIQLCFQEPCNKALSLLNIPLEAKGILDRSFLQRRLKPYRIRFCCRAL

SEQ ID NO: 16288 - protein, 509 aa, Homo sapiens
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKEIVHKAFWDCLSVQLSEDPPAYDHAIKLVGEIKETLLSFLLPGHTRLRNQITEVLDLDLIKQEAENGALDISKLAEFIIGMMGTLCAPARDEEVKKLKDIKEIVPLFREIFSVLDLMKVDMANFAISSIRPHLMQQSVEYERKKFQEILERQPNSLDFVTQWLEEASEDLMTQKYKHALPVGGMAAGSGDMPRLSPVAVQNYAYLKLLKWDHLQRPFPETVLMDQSRFHELQLQLEQLTILGAVLLVTFSMAAPGISSQADFAEKLKMIVKILLTDMHLPSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILSKILVRS

SEQ ID NO: 16289 - protein, 509 aa, Homo sapiens; identical to SEQ ID NO: 16288

SEQ ID NO: 16290 - protein, 54 aa, Homo sapiens
MSENLDKSNVNEAGKSKSNDSEEGLEDAVEGADEALQKAIKSDSSSPQRVQRPH

SEQ ID NO: 16291 - protein, 144 aa, Homo sapiens
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKEIVHKAFWDCLSVQLSEDPPAYDHAIKLVGEIKETLLSF

SEQ ID NO: 16292 - protein, 509 aa, Homo sapiens; identical to SEQ ID NO: 16288

SEQ ID NO: 16293 - protein, 519 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSALDQTTEWIKESVNEELFSLSESALTPGAENTSKPSLSPTLVLNNSYLKLLQWDYQKKELPETLMTDGARLQELTEKLNQLKIIACLSLITNNMVGAITGGLPELASRLTRISAVLLEGMNKETFNLKEVLNSIGIQTCVEVNKTLMERGLPTLNAEIQANLIGQFSSIEEEDNPIWSLIDKRIKLYMRRLLCLPSPQKCMPPMPGGLAVIQQELEALGSQYANIVNLNKQVYGPFYANILRKLLFNEEAMGKVDASPPTN

SEQ ID NO: 16294 - protein, 97 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEK

SEQ ID NO: 16295 - protein, 18 aa, Homo sapiens
MPFNGEKQCVGEDQPSDS

SEQ ID NO: 16296 - protein, 132 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKL

SEQ ID NO: 16297 - protein, 234 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLR

SEQ ID NO: 16298 - protein, 18 aa, Homo sapiens
MPFNGEKQCVGEDQPSDS

SEQ ID NO: 16299 - protein, 179 aa, Homo sapiens
MMMSDNAKGRAAHSWKKRGSISSLSNHEFWRKEIHGRIKDSMSTVSYMEEPSQRDDISRLTVQMENTYQLGPPKHFPVVTVNHILKDVVTSYLQVEEYEPELCRQMTKTISEVIKAQVKDLMIPRYKLIVIVHIGQLNRQSILIGSRCLWDPKSDTFSSYVFRNSSLFALANVYAVYLE

SEQ ID NO: 16300 - protein, 142 aa, Homo sapiens
MATSIGVSFSVGDGVPEAEKNAGEPENTYILRPVFQQRFRPSVVKDCIHAVLKEELANAEYSPEEMPQLTKHLSENIKDKLKEMGFDRYKMVVQVVIGEQRGEGVFMASRCFWDADTDNYTHDVFMNDSLFCVVAAFGCFYY

SEQ ID NO: 16301 - protein, 84 aa, Homo sapiens
MATSIGVSFSVGDGVPEAEKNAGEPENTYILRPVFQQRFRPSVVKDCIHAVLKEELANAEYSPEEMPQLTKHLSENIKDKKKKK

SEQ ID NO: 16302 - protein, 350 aa, Homo sapiens
MSAACWEEPWGLPGGFAKRVLVTGGAGFIASHMIVSLVEDYPNYMIINLDKLDYCASLKNLETISNKQNYKFIQGDICDSHFVKLLFETEKIDIVLHFAAQTHVDLSFVRAFEFTYVNVYGTHVLVSAAHEARVEKFIYVSTDEVYGGSLDKEFDESSPKQPTNPYASSKAAAECFVQSYWEQYKFPVVITRSSNVYGPHQYPEKVIPKFISLLQHNRKCCIHGSGLQTRNFLYATDVVEAFLTVLKKGKPGEIYNIGTNFEMSVVQLAKELIQLIKETNSESEMENWVDYVNDRPTNDMRYPMKSEKIHGLGWRPKVPWKEGIKKTIEWYRENFHNWKNVEKALEPFPV

SEQ ID NO: 16303 - protein, 1411 aa, Homo sapiens
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATVAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTQLPFQEQDSSPGAHDGEDIQPIGPQSTFCEVPLLNSLTVPSSLSWAPSAEQWLPGTRADEGSPVEPSQEQDILTSMEASGHLSTNLWHAVTDDDTGQKEIPISERVLGSVGGQLTPVSALAASTHKPWLEQPPRDQTLTSSDEEDIYAHGLPSSSSETSVTELGPSCSQQDLSRLGAEDAGLLKPDQFAESWMGYSGPGYGILSLVVSEKYIWCLDYKGGLFCSALPGAGLRWQKFEDAVQQVAVSPSGALLWKIEQKSNRAFACGKVTIKGKRHWYEALPQAVFVALSDDTAWIIRTSGDLYLQTGLSVDRPCARAVKVDCPYPLSQITARNNVVWALTEQRALLYREGVSSFCPEGEQWKCDIVSERQALEPVCITLGDQQTLWALDIHGNLWFRTGIISKKPQGDDDHWWQVSITDYVVFDQCSLFQTIIHATHSVATAAQAPVEKVADKLRMAFWSQQLQCQPSLLGVNNSGVWISSGKNEFHVAKGSLIGTYWNHVVPRGTASATKWAFVLASAAPTKEGSFLWLCQSSKDLCSVSAQSAQSRPSTVQLPPEAEMRAYAACQDALWALDSLGQVFIRTLSKSCPTGMHWTRLDLSQLGAVKLTSLACGNQHIWACDSRGGVYFRVGTQPLNPSLMLPAWIMIEPPVQPAGVSLVSVHSSPNDQMLWVLDSRWNVHVRTGITEEMPVGTAWEHVPGLQACQLALSTRTVWARCPNGDLARRYGVTDKNPAGDYWKKIPGSVSCFTVTASDELWAVGPPGYLLQRLTKTFSHSHGTQKSSQAAMPHPEDLEDEWEVI

SEQ ID NO: 16304 - protein, 733 aa, Homo sapiens
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATVAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTPQHTTHLTSHHSTPHHTTPHCTIPHHISPHHSTPHHTTHHTPHRTAPHRTAPYLATSHHTTPHHTSLPTHGAGCPPPGEHTSAETVKPDGCKWNLDVCTCVPGRDGTGGCMGRGGAEQGSLT

SEQ ID NO: 16305 - protein, 1267 aa, Homo sapiens
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATVAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTQLPFQEQDSSPGAHDGEDIQPIGPQSTFCEVPLLNSLTVPSSLSWAPSAEQWLPGTRADEGSPVEPSQEQDILTSMEASGHLSTNLWHAVTDDDTGQKEIPISERVLGSVGGQLTPVSALAASTHKPWLEQPPRDQTLTSSDEEDIYAHGLPSSSSETSVTELGPSCSQQDLSRLGAEDAGLLKPDQFAESWMGYSGPGYGILSLVVSEKYIWCLDYKGGLFCSALPGAGLRWQKFEDAVQQVAVSPSGALLWKIEQKSNRAFACGKVTIKGKRHWYEALPQAVFVALSDDTAWIIRTSGDLYLQTGLSVDRPCARAVKVDCPYPLSQITARNNVVWALTEQRALLYREGVSSFCPEGEQWKCDIVSERQALEPVCITLGDQQTLWALDIHGNLWFRTGIISKKPQGDDDHWWQVSITDYVVFDQCSLFQTIIHATHSVATAAQAPVEKVADKLRMAFWSQQLQCQPSLLGVNNSGVWISSGKNEFHVAKGSLIGTYWNHVVPRGTASATKWAFVLASAAPTKEGSFLWLCQSSKDLCSVSAQSAQSRPSTVQLPPEAEMRAYAACQDALWALDSLGQVFIRTLSKSCPTGMHWTRLDLSQLGAVKLTSLACGNQHIWACDSRGGVYFRVGTQPLNPSLMLPAWIMIEPPVQVSRS

SEQ ID NO: 16306 - protein, 150 aa, Homo sapiens
MDSRKLSPRGKKLESHLSQEHRRPPLGLIAAWGQPSIQSSVQQGLQTQDWVCEPPERRRPGRRWSVSIDERRRLATLGGRERPGAAGTQLHCRDVVQMVAQLVSEDVDKDVLLPHPLRSTESTNAFQAFLARSAPFWHNATFEASRSPPS

SEQ ID NO: 16307 - protein, 206 aa, Homo sapiens
MDSQQEDLRFPGMWVSLYFGILGLCSVITGGCIIFLHWRKNLRREEHAQQWVEVMRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 16308 - protein, 391 aa, Homo sapiens
MAGRSLCLTRSSVPGTPFPPPVQQPSTPGPDLLALEEEYKRLNAELQAKTADVVQQAKEIIRDRQEVRSRPVSTQMKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERELENKRRLQKQAASSQSATEVRLNRALEEAEKYKLELSKLRQNNKDIANEEHKKIEVLKSENKKLEKQKGELMIGFKKQLKLIDVLKRQKMHIEAAKMLSFTEEEFMKALEWGNS

SEQ ID NO: 16309 - protein, 316 aa, Homo sapiens
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERELENKRRLQKQAASSQSATEVRLNRALEEAEKYKLELSKLRQNNKDIANEEHKKIEVLKSENKKLEKQKGELMIGFKKQLKLIDVLKRQKMHIEAAKMLSFTEEEFMKALEWGNS

SEQ ID NO: 16310 - protein, 275 aa, Homo sapiens
MSQKRQTKFQNGKSKTSENSSAKREKGMVVNSKEISDAVGQSKFVLENLRHYTVHPNLAQYYKPLKATALQKFLAQNRKNTSFMLKVTQYDQDKTLLIMTNNPPPCSITQQDKESASKYFSKELLLKVMESHHQHKPTENLWLPRMPQKKKLRSKLKPIFPLILSDDPTSKREQWFRFSTDNDFKSEGKYSKVYALRTQKKMYPQLTFAPVHERDMRKDASKKSASERPISKVIREPLTLASLLEDMPTRTAPGESAFRNGRAPQWIIKKATVIG

SEQ ID NO: 16311 - protein, 308 aa, Homo sapiens
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 16312 - protein, 146 aa, Homo sapiens
MRPEGSLTYRVPERLRQGFCGVGRAAQALVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHST

SEQ ID NO: 16313 - protein, 294 aa, Homo sapiens
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAESPDRSYVRTCGAIPCNTTRG

SEQ ID NO: 16314 - protein, 308 aa, Homo sapiens
MRPEGSLTYRVPERLRQGSCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHRVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 16315 - protein, 264 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITGDRWLPGWVVEGRWWVDHCQRDPAPFPQKLLSL

SEQ ID NO: 16316 - protein, 171 aa, Homo sapiens
MRPEGSLTYRVPERLRQGFCGVGRAAQALVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITGDRWLPGWVVEGRWWVDHCQRDPAPFPQKLLSL

SEQ ID NO: 16317 - protein, 308 aa, Homo sapiens; identical to SEQ ID NO: 16311

SEQ ID NO: 16318 - protein, 308 aa, Homo sapiens; identical to SEQ ID NO: 16311

SEQ ID NO: 16319 - protein, 300 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAESPDRSYVRTCGAIPCNTTRG

SEQ ID NO: 16320 - protein, 314 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 16321 - protein, 308 aa, Homo sapiens
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYLDYEVEAYRRRHHNSSLNFFNWFSDHNFAGSNKIAEILCKDLWRNPLQYYKRMKPPEEGTETSGDSQLLS

SEQ ID NO: 16322 - protein, 313 aa, Homo sapiens
MRPEGSLTYWVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERSKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 16323 - protein, 294 aa, Homo sapiens
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYLDYEVEAYRRRHHNSSLNFFNWFSDHNFAGSNKIAESPDRSYVRTCGAIPCNTTRG

SEQ ID NO: 16324 - protein, 308 aa, Homo sapiens
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 16325 - protein, 206 aa, Homo sapiens
MTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYLDYEVEAYRRRHHNSSLNFFNWFSDHNFAGSNKIAEILCKDLWRNPLQYYKRMKPPEEGTETSGEPLVGT

SEQ ID NO: 16326 - protein, 275 aa, Homo sapiens; identical to SEQ ID NO: 16310

SEQ ID NO: 16327 - protein, 58 aa, Homo sapiens
MSQKRQTKFQNGKSKTSENSSAKREKGMVVNSKEISDAVGQSKFVLENLRHYTVHPNL

SEQ ID NO: 16328 - protein, 76 aa, Homo sapiens
MSQKRQTKFQNGKSKTSENSSAKREKGMVVNSKEISDAVGQSKFVLENLRHYTVHPNLAQYYKPLKATALQKFLAQ

SEQ ID NO: 16329 - protein, 275 aa, Homo sapiens; identical to SEQ ID NO: 16310

SEQ ID NO: 16330 - protein, 409 aa, Homo sapiens
MALRPEDPSSGFRHSNVVAFINEKMARHTKGPEFYLENISLSWEKVEDKLRAILEDSEVPSEVKEACTWGSLALGVRFAHRQAQLQRHRVRWLHGFAKLHKSAAQALASDLKKLREQQETERKEAASRLRMAQTSLVEVQKERDKELVSPHEWEQGAGWPGLATAGGVCTEGAAEEEEEAAVAAAGAAGGKGAEEEQRDVEVVAAPVEAMAPPVEAGAAPMETQFPHVEARAASMETTEKLERILLQLLGDADQEKYTYWGQKEGDLRSVETATSYFSGTTNPWSRASSEPLPVQLPASYSYSYSSPFSSFSDIPTISPPQATVTAPVPPQLPSDWEAFDTSLWSDGGPHRIDHQEHPRDRRYSEPHQQRPPVYRRPGDWDCPWCNAVNFSRRDTCFDCGKGIWLQKPH

SEQ ID NO: 16331 - protein, 1544 aa, Homo sapiens
MDSGPVYHGDSRQLSASGVPVNGAREPAGPSLLGTGGPWRVDQKPDWEAAPGPAHTARLEDAHDLVAFSAVAEAVSSYGALSTRLYETFNREMSREAGNNSRGPRPGPEGCSAGSEDLDTLQTALALARHGMKPPNCNCDGPECPDYLEWLEGKIKSVVMEGGEERPRLPGPLPPGEAGLPAPSTRPLLSSEVPQISPQEGLPLSQSALSIAKEKNISLQTAIAIEALTQLSSALPQPSHSTPQASCPLPEALSPPAPFRSPQSYLRAPSWPVVPPEEHSSFAPDSSAFPPATPRTEFPEAWGTDTPPATPRSSWPMPRPSPDPMAELEQLLGSASDYIQSVFKRPEALPTKPKVKVEAPSSSPAPAPSPVLQREAPTPSSEPDTHQKAQTALQQHLHHKRSLFLEQVHDTSFPAPSEPSAPGWWPPPSSPVPRLPDRPPKEKKKKLPTPAGGPVGTEKAAPGIKPSVRKPIQIKKSRPREAQPLFPPVRQIVLEGLRSPASQEVQAHPPAPLPASQGSAVPLPPEPSLALFAPSPSRDSLLPPTQEMRSPSPMTALQPGSTGPLPPADDKLEELIRQFEAEFGDSFGLPGPPSVPIQDPENQQTCLPAPESPFATRSPKQIKIESSGAVTVLSTTCFHSEEGGQEATPTKAENPLTPTLSGFLESPLKYLDTPTKSLLDTPAKRAQAEFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTVVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 16332 - protein, 1660 aa, Homo sapiens
MDSGPVYHGDSRQLSASGVPVNGAREPAGPSLLGTGGPWRVDQKPDWEAAPGPAHTARLEDAHDLVAFSAVAEAVSSYGALSTRLYETFNREMSREAGNNSRGPRPGPEGCSAGSEDLDTLQTALALARHGMKPPNCNCDGPECPDYLEWLEGKIKSVVMEGGEERPRLPGPLPPGEAGLPAPSTRPLLSSEVPQISPQEGLPLSQSALSIAKEKNISLQTAIAIEALTQLSSALPQPSHSTPQASCPLPEALSPPAPFRSPQSYLRAPSWPVVPPEEHSSFAPDSSAFPPATPRTEFPEAWGTDTPPATPRSSWPMPRPSPDPMAELEQLLGSASDYIQSVFKRPEALPTKPKVKVEAPSSSPAPAPSPVLQREAPTPSSEPDTHQKAQTALQQHLHHKRSLFLEQVHDTSFPAPSEPSAPGWWPPPSSPVPRLPDRPPKEKKKKLPTPAGGPVGTEKAAPGIKPSVRKPIQIKKSRPREAQPLFPPVRQIVLEGLRSPASQEVQAHPPAPLPASQGSAVPLPPEPSLALFAPSPSRDSLLPPTQEMRSPSPMTALQPGSTGPLPPADDKLEELIRQFEAEFGDSFGLPGPPSVPIQDPENQQTCLPAPESPFATRSPKQIKIESSGAVTVLSTTCFHSEEGGQEATPTKAENPLTPTLSGFLESPLKYLDTPTKSLLDTPAKRAQAEFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTVVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLDRAWQSFGLPLGSSEKLFGALKSEEKLWDPFSLEEGPAEEPPSKGAVKEEKGGGGAEEEEEELWSDSEHNFLDENIGGVAVAPAHGSILIECARRELHATTPLKKPNRCHPTRISLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 16333 - protein, 252 aa, Homo sapiens [sequence omitted]

SEQ ID NO: 16334 - protein, 252 aa, Homo sapiens [sequence omitted]

SEQ ID NO: 16335 - protein, 252 aa, Homo sapiens [sequence omitted]

SEQ ID NO: 16336 - protein, 51 aa, Homo sapiens
MTHDKSWRRCSISGSTKCRCGSRIAGPNALGSGGSRSSSSSSRSILSSSIL

SEQ ID NO: 16337 - protein, 21 aa, Homo sapiens
MTHDKSWRRCSISGSTKCRCG

SEQ ID NO: 16338 - protein, 75 aa, Homo sapiens
MTHDKSWRRCSISGSTKCRCGSRIAGPNALGSGGSRSSSSSSRSILSSSILSSSIPSSSSSSSSPSSSPSSSSPS

SEQ ID NO: 16339 - protein, 43 aa, Homo sapiens
MTHDKSWRRCSISGSTKCRCGSRIAGPNALGSGGSRSSSSSSR

SEQ ID NO: 16340 - protein, 38 aa, Homo sapiens
MTHDKSWRRCSISGSTKCRCGSRIAGPNALGSGGSRSS

SEQ ID NO: 16341 - protein, 12 aa, Homo sapiens
MTHDKSWRRCSI

SEQ ID NO: 16342 - protein, 20 aa, Homo sapiens
MTHDKSWRRCSISGSTKCRC

SEQ ID NO: 16343 - protein, 150 aa, Homo sapiens
MTHDKSWRRCSISGSTKCRCGSRIAGPNALGSGGSRSSSSSSRSILSSSILSSSIPSSSSSSSSPSSSPSSSSPSSSHSSSSPSSSSSTSSPSSSSSSSSSSPSSSNSSSSSSSSSPSSSSSSSSSSPSSSSSSPSSSSSSSSSSPSSSS

SEQ ID NO: 16344 - protein, 248 aa, Homo sapiens
MLRNNKTIIIKYFLNLINGAFLVLGLLFMGFGAWLLLDRNNFLTAFDENNHFIVPISQILIGMGSSTVLFCLLGYIGIHNEIRWLLIVYAVLITWTFAVQVVLSAFIITKKEEVQQLWHDKIDFVISEYGSKDKPEDITKWTILNALQKTLQCCGQHNYTDWIKNKNKENSGQVPCSCTKSTLRKWFCDEPLNATYLEGCENKISAWYNVNVLTLIGINFGLLTSEVFQVSLTVCFFKNIKNIIHAEM

SEQ ID NO: 16345 - protein, 88 aa, Homo sapiens
MLRNNKTIIIKYFLNLINGAFLVLGLLFMGFGAWLLLDRNNFLTAFDENNHFIVPISQILIGMGSSTVLFCLLGYIGIHNEIRWLLIV

SEQ ID NO: 16346 - protein, 2375 aa, Homo sapiens
MHILFQKGMLKRVKKLLDLLVKFDINFNLKNKEGKDARHRIKKNDSLLLAWNKALMENRRRSRQDSAAHLGKLSKSTAPGHTSQLKSQGSFKSVPCGATARTLPEGSAVPDSWETLPGTQVTRKEPGALRPCSLRDCLMQDITVLIQQVEVDPSFPEDCLQSSEPLEAGAGKEGKKDDKPTLGAGAPDCSEVGEGHAQVGLGALQLVPDDNRGKEGNDDQDDWSTQEIEACLQDFDNMTWEIECTSEMLKKLSSKVMTKVIKKKIILAIQQLGNGEWTQGLQKRLKHLKGSIQLFEAKLDKGARMLWELAIDFSPRCSENPEKIIATEQNTCAMEKSGRIYTEIIRIWDIVLDHCKLADSIKAICNAYNRGLSCVLRKKLKGINKGQVSANMKIQKRIPRCYVEDTEAEKGREHVNPEYFPPASAVETEYNIMKFHSFSTNMAFNILNDTTATVEYPFRVGELEYAVIDLNPRPLEPIILIGRSGTGKTTCCLYRLWKKFHVYWEKAEQAGSPLLAKQVWLKRRLEVEPGKESPGGEEEEEEEDEEEEDSIEVETVESIDEQEYEACAGGAGVEPAGDGQAAEVCAPEHPHQLEHLHQIFVTKNHVLCQEVQRNFIELSKSTKATSHYKPLDPNIHKLQDLRDENFPLFVTSKQLLLLLDASLPKPFFLRNEDGSLKRTIIGWSAQEESTIPSWQEDEEEAEVDGDYSEEDKAVEMRTGDSDPRVYVTFEVFKNEIWPKMTKGRTAYNPALIWKEIKSFLKGSFEALSCPHGRLTEEVYKKLGRKRCPNFKEDRSEIYSLFSLYQQIRSQKGYFDEEDVLYNISRRLSKLRVLPWSIHELYGDEIQDFTQAELALLMKCINDPNSMFLTGDTAQSIMKGVAFRFSDLRSLFHYASRNTIDKQCAVRKPKKIHQLYQNYRSHSGILNLASGVVDLLQFYFPESFDRLPRDSGLFDGPKPTVLESCSVSDLAILLRGNKRKTQPIEFGAHQVILVANETAKEKIPEELGLALVLTIYEAKGLEFDDVLLYNFFTDSEAYKEWKIISSFTPTSTDSREENRPLVEVPLDKPGSSQGRSLMVNPEMYKLLNGELKQLYTAITRARVNLWIFDENREKRAPAFKYFIRRDFVQVVKTDENKDFDDSMFVKTSTPAEWIAQGDYYAKHQCWKVAAKCYQKGGAFEKEKLALAHDTALSMKSKKVSPKEKQLEYLELAKTYLECKEPTLSLKCLSYAKEFQLSAQLCERLGKIRDAAYFYKRSQCYKDAFRCFEQIQEFDLALKMYCQEELFEEAAIAVEKYEEMLKTKTLPISKLSYSASQFYLEAAAKYLSANKMKEMMAVLSKLDIEDQLVFLKSRKRLAEAADLLNREGRREEAALLMKQHGCLLEAARLTADKDFQASCLLGAARLNVARDSDIEHTKDILREALDICYQTGQLSGIAEAHFLQGVILRDFQKLRDAFFKFDTLNHSAGVVEALYEAASQCEAEPEKILGLAPGGLEILLSLVRALKRVTNNAEKEMVKSCFEFFGISQVDAKYCQIAQNDPGPILRIIFDLDLNLREKKTKDHFLIMTDQVKLALNKHLLGRLCQITRSLLGKTYRGVCMRFIVGLKCEDENCEHFHRPLRRCEAKCLVQSKMNLVAINGLLLEAKKVFPKILAEELKEIDYILSTDMYGLCKSILDVLFPKHFHQRVLSENPMACKEILKPNYKSFRFYRFALKEYIHFLFENESARNRRESTDLWLSAMQAFLLSSNYPEEFEKLLHQEEDNYNRELKALESEKDERGRGRGSRIKGIEGKFGMLAPNRDDENMDKTHLCFIRLLENCIDQFYVYRNPEDYKRLFFRFMNVLIKRCKEPLIPSIGNTVALLEFQFIHCGVVLARLWKNVILCLPKSYIALLHYWEFLFSKKDKELGDVFSIIQEYKPKDVTRAIQDFRFHLSYLAKVLCGYENVNFNVLLDAFSEIDYVVSGEAERTLVLCLVMLVNAEEILQPYCKPLLYRHFREIESRLQLMSMDCPGQVPERLLKVVKRVLVAVNVKSVAEALQDLLFERDEEYLMDCDWRWDPVHTKGSIVRGLYYEEVRLNRLLCLDPVDYFAEPECEFGQDEMDELALEDRDHVLATILSQKQRKASIQRKLRRACLVVSLCISWRRRVGTQMERVREEAREPRAGNFKKADVDRTQCDLCGVKFTRGPENYFSPSKAFEGAASEVAVLSRAELEREECQERNSESYEQHIHLEHHQRQQVAYQKYSEFFHEKVDPAIDEGKLVVQDIEQSVWIHSHVGSKEHSHMLQKVQEHIKRVSDMVEDLYRRKAWAGAEEAMTRLVNILILSVRDARDWLMKTETRLKKEGIVQEDDYENEVEDFGELRPRRRSRKCGKQRKY

SEQ ID NO: 16347 - protein, 2375 aa, Homo sapiens; identical to SEQ ID NO: 16346

SEQ ID NO: 16348 - protein, 2925 aa, Homo sapiens
MWDPRAARVPPRDLAVLLCNKSNAFFSLGKWNEAFVAAKECLQWDPTYVKGYYRAGYSLLRLHQPYEAARMFFEGLRLVQRSQDQAPVADFLVGVFTTMSSDSIVLQSFLPCFDHIFTTGFPTEVWQSVIEKLAKKGLWHSFLLLSAKKDRLPRNIHVPELSLKSLFEKYVFIGLYEKMEQVPKLVQWLISIGASVETIGPYPLHALMRLCIQARENHLFRWLMDHKPEWKGRINQKDGDGCTVLHVVAAHSPGYLVKRQTEDVQMLLRFGADPTLLDRQSRSVVDVLKRNKNFKAIEKINSHLEKLATCSKDLSGFSNGDGPTSENDIFRKVLEQLVKYMNSGNRLLHKNFLKQEVVQRFLRLLSTLQEIPPDLVCDINQDCATTVFKFLLEKQRWPEVLLLLTRKVSGEPPLGDCLIKDCNFSDLDICTIIPHLSTWDQRKKQLLGCLIDSGALPDGLQESQERPVVTCLKHEDFELAFLLLTKGADPRAISLTEGDTPLHAALHIFLEIKADIGFSFLSHLLDLFWSNPTEFDYLNPNVQDSNGNTLMHILFQKGMLKRVKKLLDLLVKFDINFNLKNKEGKDARHRIKKNDSLLLAWNKALMENRRRSRQDSAAHLGKLSKSTAPGHTSQLKSQGSFKSVPCGATARTLPEGSAVPDSWETLPGTQVTRKEPGALRPCSLRDCLMQDITVLIQQVEVDPSFPEDCLQSSEPLEAGAGKEGKKDDKPTLGAGAPDCSEVGEGHAQVGLGALQLVPDDNRGKEGNDDQDDWSTQEIEACLQDFDNMTWEIECTSEMLKKLSSKVMTKVIKKKIILAIQQLGNGEWTQGLQKRLKHLKGSIQLFEAKLDKGARMLWELAIDFSPRCSENPEKIIATEQNTCAMEKSGRIYTEIIRIWDIVLDHCKLADSIKAICNAYNRGLSCVLRKKLKGINKGQVSANMKIQKRIPRCYVEDTEAEKGREHVNPEYFPPASAVETEYNIMKFHSFSTNMAFNILNDTTATVEYPFRVGELEYAVIDLNPRPLEPIILIGRSGTGKTTCCLYRLWKKFHVYWEKAEQAGSPLLAKQVWLKRRLEVEPGKESPGGEEEEEEEDEEEEDSIEVETVESIDEQEYEACAGGAGVEPAGDGQAAEVCAPEHPHQLEHLHQIFVTKNHVLCQEVQRNFIELSKSTKATSHYKPLDPNIHKLQDLRDENFPLFVTSKQLLLLLDASLPKPFFLRNEDGSLKRTIIGWSAQEESTIPSWQEDEEEAEVDGDYSEEDKAVEMRTGDSDPRVYVTFEVFKNEIWPKMTKGRTAYNPALIWKEIKSFLKGSFEALSCPHGRLTEEVYKKLGRKRCPNFKEDRSEIYSLFSLYQQIRSQKGYFDEEDVLYNISRRLSKLRVLPWSIHELYGDEIQDFTQAELALLMKCINDPNSMFLTGDTAQSIMKGVAFRFSDLRSLFHYASRNTIDKQCAVRKPKKIHQLYQNYRSHSGILNLASGVVDLLQFYFPESFDRLPRDSGLFDGPKPTVLESCSVSDLAILLRGNKRKTQPIEFGAHQVILVANETAKEKIPEELGLALVLTIYEAKGLEFDDVLLYNFFTDSEAYKEWKIISSFTPTSTDSREENRPLVEVPLDKPGSSQGRSLMVNPEMYKLLNGELKQLYTAITRARVNLWIFDENREKRAPAFKYFIRRDFVQVVKTDENKDFDDSMFVKTSTPAEWIAQGDYYAKHQCWKVAAKCYQKGGAFEKEKLALAHDTALSMKSKKVSPKEKQLEYLELAKTYLECKEPTLSLKCLSYAKEFQLSAQLCERLGKIRDAAYFYKRSQCYKDAFRCFEQIQEFDLALKMYCQEELFEEAAIAVEKYEEMLKTKTLPISKLSYSASQFYLEAAAKYLSANKMKEMMAVLSKLDIEDQLVFLKSRKRLAEAADLLNREGRREEAALLMKQHGCLLEAARLTADKDFQASCLLGAARLNVARDSDIEHTKDILREALDICYQTGQLSGIAEAHFLQGVILRDFQKLRDAFFKFDTLNHSAGVVEALYEAASQCEAEPEKILGLAPGGLEILLSLVRALKRVTNNAEKEMVKSCFEFFGISQVDAKYCQIAQNDPGPILRIIFDLDLNLREKKTKDHFLIMTDQVKLALNKHLLGRLCQITRSLLGKTYRGVCMRFIVGLKCEDENCEHFHRPLRRCEAKCLVQSKMNLVAINGLLLEAKKVFPKILAEELKEIDYILSTDMYGLCKSILDVLFPKHFHQRVLSENPMACKEILKPNYKSFRFYRFALKEYIHFLFENESARNRRESTDLWLSAMQAFLLSSNYPEEFEKLLHQEEDNYNRELKALESEKDERGRGRGSRIKGIEGKFGMLAPNRDDENMDKTHLCFIRLLENCIDQFYVYRNPEDYKRLFFRFMNVLIKRCKEPLIPSIGNTVALLEFQFIHCGVVLARLWKNVILCLPKSYIALLHYWEFLFSKKDKELGDVFSIIQEYKPKDVTRAIQDFRFHLSYLAKVLCGYENVNFNVLLDAFSEIDYVVSGEAERTLVLCLVMLVNAEEILQPYCKPLLYRHFREIESRLQLMSMDCPGQVPERLLKVVKRVLVAVNVKSVAEALQDLLFERDEEYLMDCDWRWDPVHTKGSIVRGLYYEEVRLNRLLCLDPVDYFAEPECEFGQDEMDELALEDRDHVLATILSQKQRKASIQRKLRRACLVVSLCISWRRRVGTQMERVREEAREPRAGNFKKADVDRTQCDLCGVKFTRGPENYFSPSKAFEGAASEVAVLSRAELEREECQERNSESYEQHIHLEHHQRQQVAYQKYSEFFHEKVDPAIDEGKLVVQDIEQSVWIHSHVGSKEHSHMLQKVQEHIKRVSDMVEDLYRRKAWAGAEEAMTRLVNILILSVRDARDWLMKTETRLKKEGIVQEDDYENEVEDFGELRPRRRSRKCGKQRKY

SEQ ID NO: 16349 - protein, 860 aa, Homo sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 16350 - protein, 806 aa, Homo sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 16351 - protein, 807 aa, Homo sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 16352 - protein, 770 aa, Homo sapiens
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGGRSEDPRDFYNSYKTQAGSSKTEKPYKSERHFSSRRNSSDSFCRNSEDKIYGYRRFEKDIEGRKEHYRRWEPGSVRHSTSPASSEYSWKSVEKYKKYAHSGSRDFSRHEQRYRLNTNQGEYEREDNYGEDIKTEVPEEDALSSKEHSESSVKKNLPQNLLNIFNQIAEFEKEKGNKSKN

SEQ ID NO: 16353 - protein, 653 aa, Homo sapiens
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGVYSYLFKKLTIKQPQAGPSGDIPEEGIVIIDDSSIHVTDPEDLQVGQDMEVEDSGIDDPDHG

SEQ ID NO: 16354 - protein, 439 aa, Homo sapiens
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQVIPYFLLEI

SEQ ID NO: 16355 - protein, 374 aa, Homo sapiens
MAWLDSRNTSLPSLGFCLLLLPLHPAPLLPTTPTPALCPGLVHSQGHPSACPHFPHSYSRGQQCLEQADWETAVLLFSRALHLDPQLGQCLFEQCAFLDALNVFSHAAELQPEKPCFRYRCMACLLALKQHQACLTLITNELKQDTTNADVYIFRARLYNFLQKPHLCYRDLHSALLLNPKHPQARMLLQKMVAQAQQARQDAGILAVQGKLARTAADQPCHREQPSGPQSLPLPGHHVPTAPGVRWGSGGLPEGAGHGDRGPGGHGAAGTAPAVADLQRLCRALLQAGRLPGGRAAAEQGPPGRAAGERTLHQPRRQFQKAENHFSTAIRHNPQKAQYYLYRAKSRQLLQNIFGARQDVATVLLLNPKQPKDA

SEQ ID NO: 16356 - protein, 409 aa, Homo sapiens
MHGLSPGPQAASGLPHAHHQRAEAGHHQRRCLHLPGQTLQLSPEAPPLLPGPAQRLAVESQAPAGQDAAPEDGGPGPAGAPRCGDPGCAGQAAARTAADQPCHREQPSGPQSLPLPGHHVPTAPGVRWGSGGLPEGAGHGDRGPGGHGAAGTAPAVADLQRLCRALLQAGRLPGGRAAAEQGPPGRAAGERTLHQPRRQFQKAENHFSTAIRHNPQKAQYYLYRAKSRQLLQNIFGARQDVATVLLLNPKQPKLSLLMTNLFPGMSVEEVLSTQIAHLARLQLEQMVEGSLQAGSPQGIVGMLKRHELERQKALALQHSWKQGEPLIATSEELKATPEIPQVKPGSSEGEAEAPEEEEEKEKEKKEVSGVQARARSPWGLGHSVPQPRAEGCRPVESGFQAWLCTPSAV

SEQ ID NO: 16357 - protein, 873 aa, Homo sapiens
MTDSDEDALKVDQGPSRDIPKPWVIPAPKGILQHIFGTSHVFQSICDVKPKVTGLTVPLKVREYYSRGQQCLEQADWETAVLLFSRALHLDPQLVDFYALRAEAYLQLCDFSSAAQNLRRAYSLQQDNCKHLERLTFVLYLQGQCLFEQCAFLDALNVFSHAAELQPEKPCFRYRCMACLLALKQHQACLTLITNELKQDTTNADVYIFRARLYNFLQKPHLCYRDLHSALLLNPKHPQARMLLQKMVAQAQQARQDAGILAVQGKLQHALQRINRAIENNPLDPSLFLFRGTMYRRLQEFDGAVEDFLKVLDMVTEDQEDMVRQAQRQLLLTYNDFAVHCYRQGAYQEGVLLLNKALRDEQQEKGLYINRGDCFFQLGNLAFAEADYQQALALSPQDEGANTRMGLLQEKMGFCEQRRKQFQKAENHFSTAIRHNPQKAQYYLYRAKSRQLLQNIFGARQDVATVLLLNPKQPKLSLLMTNLFPGMSVEEVLSTQIAHLARLQLEQMVEGSLQAGSPQGIVGMLKRHELERQKALALQHSWKQGEPLIATSEELKATPEIPQVKPGSSEGEAEAPEEEEEKEKEKKEEKKSELIPSKVASLSDSYLDQTSSASSMSFRTTGTSETEMSAICQEYRSTSATAVTFSDSSLLKTQSSDSGNNREALSHGPRKIKATQGQRQSLSKTEPTQSQRRNSSKTKATIHKRNSSKTKATQSQRRNSSKTRATQGQGQSSSKTEATQGQRQSSSEIEATQGPRQEPSKTKTTRSPRQRPRKVKAARGRSWRPSKVDATQGRSRGLLRSSTKTEAFYDSNWSLSKTEYAQGQGQRSSKAEGAQGKSQGMSSTSSKAESTWGPSPSLSKTEVDQDLTYYEAV

SEQ ID NO: 16358 - protein, 241 aa, Homo sapiens
MACLLALKQHQACLTLITNELKQDTTNADVYIFRARLYNFLQKPHLCYRDLHSALLLNPKHPQARMLLQKMVAQAQQARQDAGILAVQGKLQHALQRINRAIENNPLDPSLFLFRGTMYRRLQEFDGAVEDFLKVLDMVTEDQEDMVRQAQRQLLLTYNDFAVHCYRQGAYQEGVLLLNKALRDEQQEKGLYINRGGAQRPGHWGGGVRGSLAISKAPTGHLRPLGGRRKGERKEAREEEM

SEQ ID NO: 16359 - protein, 1141 aa, Homo sapiens
MAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 16360 - protein, 956 aa, Homo sapiens
MAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGLLDWKTRKVP

SEQ ID NO: 16361 - protein, 1121 aa, Homo sapiens
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLKLGGEREPVPRPKKWPIANILAPGANNIPDAFIVGGPYEEEEGELNHPEDSEFRNQAECIKKRIIWDLESRCYLDPSAVVSFQKRIADCRLWPVEITRVPLVTIPKGKAGKTEKTDEEAQLSFHGVAYVNMVPLLYPGVKRIRGAFHVYPYLDSVVHEKTKCLLSLFRDIGHHLIHNNKIGGINSLLSKQAVSKNLKEDKPVKEKDIDGRPRPGDVQAPSIKSQSSDTPLEGEPPLSHNPEGQQYVEAGTYIVLEIQLDKALVPKRMPEELARRVKEMIPPRPPLTRRTGGAQKAMSDYHIQIKNISRAILDEYYRMFGKQVAKLESDMDSETLEEQKCQLSYELNCSGKYFAFKEQLKHAVVKIVRDKYLKTTSFESQEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 16362 - protein, 361 aa, Homo sapiens
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLNGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 16363 - protein, 1121 aa, Homo sapiens; identical to SEQ ID NO: 16361

SEQ ID NO: 16364 - protein, 585 aa, Homo sapiens
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLKLGGEREPVPRPKKWPIANILAPGANNIPDAFIVGGPYEEEEGELNHPEDSEFRNQAECIKKRIIWDLESRCYLDPSAVVSFQKRIADCRLWPVEITRVPLVTIPKGKAGKTEKTDEEAQLSFHGVAYVNMVPLLYPGVKRIRGAFHVYPYLDSVVHEKTKCLLSLFRDIGHHLIHNNKIGGINSLLSKQAVSKNLKEDKPVKEKDIDGRPRPGDVQAPSIKSQSSDTPLEGEPPLSHNPEGQQYVEAGTYIVLEIQLDKALVPKRMPEELARRVKEMIPPRPPLTRRTGGAQKAMSDYHIQIKNISRAILDEYYRMFGKQVAKLESDMDSETLEEQAYKYMIKLKLKDEALLAEIHTLQETVGFGNPSF

SEQ ID NO: 16365 - protein, 119 aa, Homo sapiens
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQS

SEQ ID NO: 16366 - protein, 1091 aa, Homo sapiens
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLKLGGEREPVPRPKKWPIANILAPGANNIPDAFIVGGPYEEEEGELNHPEDSEFRNQAECIKKRIIWDLESRCYLDPSAVVSFQKRIADCRLWPVEITRVPLVTIPKGKAGKTEKTDEEAQLSFHGVAYVNMVPLLYPGVKRIRGAFHVYPYLDSVVHEKTKCLLSLFRDIGHHLIHNNKIGGINSLLSKQAVSKNLKEDKPVKEKDIDGRPRPGDVQAPSIKSQSSDTPLEGEPPLSHNPEGQQYVEAGTYIVLEIQLDKALVPKRMPEELARRVKEMIPPRPPLTRRTGGAQKAVSDYHIQIKNISRAILDEYYRMFGKQVAKLESDMDSETLEEQKCQLSYELNCSGKYFAFKEQLKHAVVKIVRDKYLKTTSFESQEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKELEELTEAEDALSEANALNNYNAEVWAYLALVCLKVGRQLEAEQAYKYMIKLKLKDEALLAEIHTLQETVGFGNPSF

SEQ ID NO: 16367 - protein, 1121 aa, Homo sapiens
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLKLGGEREPVPRPKKWPIANILAPGANNIPDAFIVGGPYEEEEGELNHPEDSEFRNQAECIKKRIIWDLESRCYLDPSAVVSFQKRIADCRLWPVEITRVPLVTIPKGKAGKTEKTDEEAQLSFHGVAYVNMVPLLYPGVKRIRGAFHVYPYLDSVVHEKTKCLLSLFRDIGHHLIHNNKIGGINSLLSKQAVSKNLKEDKPVKEKDIDGRPRPGDVQAPSIKSQSSDTPLEGEPPLSHNPEGQQYVEAGTYIVLEIQLDKALVPKRMPEELARRVKEMIPPRPPLTRRTGGAQKAVSDYHIQIKNISRAILDEYYRMFGKQVAKLESDMDSETLEEQKCQLSYELNCSGKYFAFKEQLKHAVVKIVRDKYLKTTSFESQEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 16368 - protein, 498 aa, Homo sapiens
QEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKELEELTEAEDALSEANALNNYNAEVWAYLALVCLKVGRQLEAEQAYKYMIKLKLKDEALLAEIHTLQETVGFGNPSF

SEQ ID NO: 16369 - protein, 1321 aa, Homo sapiens
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWVDLTSDKPHTAKKAIEYLEQGIQDTKDVLGLMGKAMYFMMQQNYSEALEVVNQITVTSGSFLPALVLKMQLFLARQDWEQTVEMGHRILEKDESNIDACQILTVHELAREGNMTTVSSLKTQKATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEAEYRLEFLKEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSGELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARRSLRP

SEQ ID NO: 16370 - protein, 1303 aa, Homo sapiens
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWVDLTSDKPHTAKKAIEYLEQGIQDTKDVLGLMGKAMYFMMQQNYSEALEVVNQITVTSGSFLPALVLKMQLFLARQDWEQTVEMGHRILEKDESNIDACQILTVHELAREGNMTTATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSGELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARRSLRP

SEQ ID NO: 16371 - protein, 1320 aa, Homo sapiens
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWVDLTSDKPHTAKKAIEYLEQGIQDTKDVLGLMGKAMYFMMQQNYSEALEVVNQITVTSGSFLPALVLKMQLFLARQDWEQTVEMGHRILEKDESNIDACQILTVHELAREGNMTTVSSLKTQKATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEAEYRLEFLKEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARRSLRP

SEQ ID NO: 16372 - protein, 1272 aa, Homo sapiens
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAMYFMMQQNYSEALEVVNQITVTSGSFLPALVLKMQLFLARQDWEQTVEMGHRILEKDESNIDACQILTVHELAREGNMTTATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEAEYRLEFLKEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSGELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARRSLRP

SEQ ID NO: 16373 - protein, 372 aa, Homo sapiens
MAELEAVADDLDALIDDLDYLPGHFHLEMQLNFEPRSPAPQRARDLKLQREGLRQELQLAAAPQRPAVRHLLGAFAFYLEELDEARECFLEVAHEHPGNLNAWANLAHVYGRLGQEEEEEACAARLADLMGLAEEPEAAGDPQLRAARCLAEQGYAHGFDVGCASPEERARGLAAGIALYDKALGYGQQIPMEEKRGWYFTMATLYIRLDGIFLELGSEEQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKRRGLTMLPRLVSNSWAQAVLPPRPPKVLEFQV

SEQ ID NO: 16374 - protein, 569 aa, Homo sapiens
MAELEAVADDLDALIDDLDYLPGHFHLEMQLNFEPRSPAPQRARDLKLQREGLRQELQLAAAPQRPAVRHLLGAFAFYLEELDEARECFLEVAHEHPGNLNAWANLAHVYGRLGQEEEEEACAARLADLMGLAEEPEAAGDPQLRAARCLAEQGYAHGFDVGCASPEERARGLAAGIALYDKALGYGQQIPMEEKRGWYFTMATLYIRLDGIFLELGSEEQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKIHIRAYLHDLKRAKMGLGGMPDRNHLACAKADLEEVVRVCPGFKAYLDIGQVYYYMGVDAVQELLAVDEAALNQALVFLAKAGESELGATLPELQLLRGKCLRIKGEDANAAACFKRAVELDDAGSSHTDGFGCLLEALLAQWSQAQLSDGELGREVDAWLRRAQDKYPAARLRQELQRVWRGHTDEVLGLARALVAQGRPALVRLLFETMEREGEGASAPRDRRAVSF

SEQ ID NO: 16375 - protein, 447 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKCLQIQTLLYGPQDKRTLATQQAMGMLSTAPKVASKPRQASKAKVAFCTSIPQDTLLGKARPGTTAD

SEQ ID NO: 16376 - protein, 393 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKGDLSFLLSATLP

SEQ ID NO: 16377 - protein, 447 aa, Homo sapiens; identical to SEQ ID NO: 16375

SEQ ID NO: 16378 - protein, 447 aa, Homo sapiens; identical to SEQ ID NO: 16375

SEQ ID NO: 16379 - protein, 447 aa, Homo sapiens; identical to SEQ ID NO: 16375

SEQ ID NO: 16380 - protein, 56 aa, Homo sapiens
MQESQETHISNHLDEVVAAVSITHRKKFQNKLLQTALFQPPREKLHLCEEKAKSYS

SEQ ID NO: 16381 - protein, 447 aa, Homo sapiens; identical to SEQ ID NO: 16375

SEQ ID NO: 16382 - protein, 447 aa, Homo sapiens; identical to SEQ ID NO: 16375

SEQ ID NO: 16383 - protein, 53 aa, Homo sapiens
MQESQETHISNHLDEVVAAVSITHRKKFQNKLLQTALFQPPREKLHLCEEKAK

SEQ ID NO: 16384 - protein, 151 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQ

SEQ ID NO: 16385 - protein, 83 aa, Homo sapiens
MQESQETHISNHLDEVVAAVSITHRKKFQNKLLQTALFQPPREKLHLCEEKAKSYSNSHEYKQAVHELVRCVALTRICYGDSH

SEQ ID NO: 16386 - protein, 115 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKAR

SEQ ID NO: 16387 - protein, 157 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAA

SEQ ID NO: 16388 - protein, 447 aa, Homo sapiens; identical to SEQ ID NO: 16375

SEQ ID NO: 16389 - protein, 447 aa, Homo sapiens; identical to SEQ ID NO: 16375

SEQ ID NO: 16390 - protein, 447 aa, Homo sapiens; identical to SEQ ID NO: 16375

SEQ ID NO: 16391 - protein, 447 aa, Homo sapiens; identical to SEQ ID NO: 16375

SEQ ID NO: 16392 - protein, 361 aa, Homo sapiens
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQDK

SEQ ID NO: 16393 - protein, 361 aa, Homo sapiens
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRCREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQDR

SEQ ID NO: 16394 - protein, 355 aa, Homo sapiens
  MOD_RES (1)..(1): Any amino acid
XSTERRLLGHLYNDLGLGYSQLQLFPLAVEAFLQALPLCWVPGEQATVLRNLGMAHNALGNYQEAREFHQKAADLHGSVGQRWEQGRSFGSLAFALSQLGDHKAARDNYLHALQAARDSGDMKGQWQACEGLGAAAARLGQYDQALKYYKEALAQCQKEPDSVRERLVAKLADTVRTRLAQVGLVQTHTLTSAPGRLQAPGGASQAEGTPAKAGSSTAGVQHRSSSGWEDEEFEEGHQKKKEERSANVPVRAGPGRPELCFLPGTVNHSHHLASSCPTFTKHTPCRGTVLGKASIYSPGPRAHLPFVGPGPPRAEYPSILVPNGPQANRSSRWPRESLSRSRQRRPMESGICTIV

SEQ ID NO: 16395 - protein, 582 aa, Homo sapiens
MSSPNPEDVPRRPEPEPSSSNKKKKKRKWLRQEASIQALTRAGHGALQAGQNHEALNNFQRAFLLASKAPQTRDTPVLQACAFNLGAAYVETGDPARGLELLLRAHPEEKAQGRRHGDQCFNVALAYHALGELPQALAWYHRALGHYQPQGDQGEAWAKMGACYQALGQPELAAHCLQEASQAYAQERQLRAAALALGAAAGCMLKSGRHRVGEVVQVLEKSRRLAERSTERRLLGHLYNDLGLGYSQLQLFPLAVEAFLQALPLCWVPGEQATVLRNLGMAHNALGNYQEAREFHQKAADLHGSVGQRWEQGRSFGSLAFALSQLGDHKAARDNYLHALQAARDSGDMKGQWQACEGLGAAAARLGQYDQALKYYKEALAQCQKEPDSVRERLVAKLADTVRTRLAQVGLVQTHTLTSAPGRLQAPGGASQAEGTPAKAGSSTAGVQHRSSSGWEDEEFEEGHQKKKEERSANVPVRAGPGRPELCFLPGTVNHSHHLASSCPTFTKHTPCRGTVLGKASIYSPGPRAHLPFVGPGPPRAEYPSILVPNGPQANRSSRWPRESLSRSRQRRPMESGICTIV

SEQ ID NO: 16396 - protein, 582 aa, Homo sapiens; identical to SEQ ID NO: 16395

SEQ ID NO: 16397 - protein, 183 aa, Homo sapiens
  MOD_RES (1)..(1): Any amino acid
XHLYNDLGLGYSQLQLFPLAVEAFLQALPLCWVPGEQATVLRNLGMAHNALGNYQEAREFHQKAADLHGSVGQRWEQGRSFGSLAFALSQLGDHKAARDNYLHALQAARDSGARFCARTAGGQAGRHREDALGPGGAGPDSHPDFGSGKTPGSRWGQPGGGDPSKGRKQHSRCPAQIFQWVGR

SEQ ID NO: 16398 - protein, 672 aa, Homo sapiens
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKKTGNEMEKEYE

SEQ ID NO: 16399 - protein, 487 aa, Homo sapiens
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKRDPSRSAPFTEKHR

SEQ ID NO: 16400 - protein, 554 aa, Homo sapiens
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 16401 - protein, 523 aa, Homo sapiens
MMLSRAKPAVGRGVQHTDKRKKKGRKIPKLEELLSKRDFTGAITLLEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 16402 - protein, 843 aa, Homo sapiens
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGICTNFQKNNPVHTLTEVELLAFTSCLLSQPKFWAIQTSALILRTKLEKGSTRRVERAMRQTQALADQFEDKTTSVLERLKIFYCCQVPPHWAIQRQLASLLFELGCTSSALQIFEKLEMWEDVVICYERAGQHGKAEEILRQELEKKETPSLYCLLGDVLGDHSCYDKAWELSRYRSARAQRSKALLHLRNKEFQECVECFERSVKINPMQLGVWFSLGCAYLALEDYQGSAKAFQRCVTLEPDNAEAWNNLSTSYIRLKQKVKAFRTLQEALKCNYEHWQIWENYILTSTDVGEFSEAIKAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 16403 - protein, 2481 aa, Homo sapiens
MEQSPPPAPEPTQGPTPARSRRRREPESPPASAPIPLFGADTIGQRSPDGPVLSKAEFVEKVRQSNQACHDGDFHTAIVLYNEALAVDPQNCILYSNRSAAYMKIQQYDKALDDAIKARLLNPKWPKAYFRQGVALQYLGRHADALAAFASGLAQDPKSLQLLVGMVEAAMKSPMRDSLEPTYQQLQKMKLDKSPFVVVSVVGQELLTAGHHGASVVVLEAALKIGTCSLKLRGSVFSALSSAYWSLGNTEKSTGYMQQDLDVAKTLGDQTGECRAHGNLGSAFFSKGNYREALTNHRHQLVLAMKLKDREAASSALSSLGHVYTAIGDYPNALASHKQCVLLAKQSKDELSEARELGNMGAVYIAMGDFENAVQCHEQHLKIAKDLGNKREEARAYSNLGSAYHYRRNFDKAMSYHNYVLELAQELMEKAIEMRAYAGLGHAARCMQDLERAKQYHEQQLGIAEDLKDRAAEGRASSNLGIIHQMKGDYDTALKLHKTHLCIAQELSDYAAQGRAYGNMGNAYNALGMYDQAVKYHRQELQISMEVNDRASQASTHGNLAVAYQALGAHDRALQHYQNHLNIARELRDIQSEARALSNLGNFHCSRGEYVQAAPYYEQYLRLAPDLQDMEGEGKVCHNLGYAHYCLGNYQEAVKYYEQDLALAKDLHDKLSQAKAYCNLGLAFKALLNFSKAEECQKYLLSLAQSLNNSQAKFRALGNLGDIFICKKDINGAIKFYEQQLGLAHQVKDRRLEASAYAALGTAYRMIQKYDKALGYHTQELEVYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRSCQSMTSLFSNTVSPTQDGTSSLPRRQSSFAKPPLRALYDLLIAPMEGGLMHSSGPVGRHRQLILVLEGELYLIPFALLKGSSSNEYLYERFGLLAVPSIRSLSVQSKSHLRKNPPTYSSSTSMAAVIGNPKLPSAVMDRWLWGPMPSAEEEAYMVSELLGCQPLVGSVATKERVMSALTQAECVHFATHISWKLSALVLTPSMDGNPASSKSSFGHPYTIPESLRVQDDASDGESISDCPPLQELLLTAADVLDLQLPVKLVVLGSSQESNSKVTADGVIALTRAFLAAGAQCVLVSLWPVPVAASKMFIHAFYSSLLNGLKASAALGEAMKVVQSSKAFSHPSNWAGFMLIGSDVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRAVKNMVGMLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 16404 - protein, 475 aa, Homo sapiens
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKISTDLDDDLSLGRGYEAIAKVLQSQGEMTEAIKYLKKFVKIARNNFQSLDLVRASTMLGDIYNEKGYYNKASECFQQAFDTTVELMSMPLMDETKVHYGIAKAHQMMLTVNNYIESADLTSLNYLLSWKESRGNIEPDPVTEEFRGSTVEAVSQNSERLEELSRFPGDQKNET

SEQ ID NO: 16405 - protein, 319 aa, Homo sapiens
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKSPQTWMMISVWGEAMKP

SEQ ID NO: 16406 - protein, 501 aa, Homo sapiens
MIPMFTVTLEDSGTLWKSLHSSSESEMTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKISTDLDDDLSLGRGYEAIAKVLQSQGEMTEAIKYLKKFVKIARNNFQSLDLVRASTMLGDIYNEKGYYNKASECFQQAFDTTVELMSMPLMDETKVHYGIAKAHQMMLTVNNYIESADLTSLNYLLSWKESRGNIEPDPVTEEFRGSTVEAVSQNSERLEELSRFPGDQKNET

SEQ ID NO: 16407 - protein, 26 aa, Homo sapiens
MTTLPPLPMTRPKLTALARQKLPCSS

SEQ ID NO: 16408 - protein, 474 aa, Homo sapiens
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKISTDLDDDLSLGRGYEAIAKVLQSQGEMTEAIKYLKKFVKIARNNFQSLDLVRASTMLGDIYNEKGYYNKASECFQQAFDTTVELMSMPLMDETKVHYGIAKAHQMMLTVNNYIESADLTSLNYLLSWKESRGNIEPDPVTEFRGSTVEAVSQNSERLEELSRFPGDQKNET

SEQ ID NO: 16409 - protein, 501 aa, Homo sapiens; identical to SEQ ID NO: 16406

SEQ ID NO: 16410 - protein, 93 aa, Homo sapiens
MIPMFTVTLEDSGTLWKSLHSSSESEMTTLPPLPMTRPKLTALARQKLPCSSRKIPRSQLIKEKDDIDHYLEVNFKGLSKEEVAAYRNSYKKN

SEQ ID NO: 16411 - protein, 665 aa, Homo sapiens
MAGLSGAQIPDGEFTALVYRLIRDARYAEAVQLLGRELQRSPRSRAGLSLLGYCYYRLQEFALAAECYEQLGQLHPELEQYRLYQAQALYKACLYPEATRVAFLLLDNPAYHSRVLRLQAAIKYSEGDLPGSRSLVEQLLSGEGGEESGGDNETDGQVNLGCLLYKEGQYEAACSKFSATLQASGYQPDLSYNLALAYYSSRQYASALKHIAEIIERGIRQHPELGVGMTTEGFDVRSVGNTLVLHQTALVEAFNLKAAIEYQLRNYEVAQETLTDMPPRAEEELDPVTLHNQALMNMDARPTEGFEKLQFLLQQNPFPPETFGNLLLLYCKYEYFDLAADVLAENAHLTYKFLTPYLYDFLDALITCQTAPEEAFIKLDGLAGMLTEQLRRLTKQVQEARHNRDDEAIKKAVNEYDETMEKYIPVLMAQAKIYWNLENYPMVEKVFRKSVEFCNDHDVWKLNVAHVLFMQENKYKEAIGFYEPIVKKHYDNILNVSAIVLANLCVSYIMTSQNEEAEELMRKIEKEEEQLSYDDPNRKMYHLCIVNLVIGTLYCAKGNYEFGISRVIKSLEPYNKKLGTDTWYYAKRCFLSLLENMSKHMIVIHDSVIQECVQFLGHCELYGTNIPAVIEQPLEEERMHVGKNTVTDESRQLKALIYEIIGWNK

SEQ ID NO: 16412 - protein, 126 aa, Homo sapiens
MYHLCIVNLVIGTLYCAKGNYEFGISRVIKSLEPYNKKLGTDTWYYAKRCFLSLLENMSKHMIVIHDSVIQECVQFLGHCELYGTNIPAVIEQPLEEERMHVGKNTVTDESRQLKALIYEIIGWNK

SEQ ID NO: 16413 - protein, 665 aa, Homo sapiens
MAGLSGAQIPDGEFTAVVYRLIRNARYAEAVQLLGGELQRSPRSRAGLSLLGYCYYRLQEFALAAECYEQLGQLHPELEQYRLYQAQALYKACLYAEATRVAFLLLDNPAYHSRVLRLQAAIKYSEGDLPGSRSLVEQLPSREGGEESGGENETDGQINLGCLLYKEGQYEAACSKFFAALQASGYQPDLSYNLALAYYSSRQYASALKHIAEIIERGIRQHPELGVGMTTEGIDVRSVGNTLVLHQTALVEAFNLKAAIEYQLRNYEAAQEALTDMPPRAEEELDPVTLHNQALMNMDARPTEGFEKLQFLLQQNPFPPETFGNLLLLYCKYEYFDLAADVLAENAHLIYKFLTPYLYDFLDAVITCQTAPEEAFIKLDGLAGMLTEVLRKLTIQVQEARHNRDDEAIKKAVNEYDETMEKYIPVLMAQAKIYWNLENYPMVEKIFRKSVEFCNDHDVWKLNVAHVLFMQENKYKEAIGFYEPIVKKHYDNILNVSAIVLANLCVSYIMTSQNEEAEELMRKIEKEEEQLSYDDPDKKMYHLCIVNLVIGTLYCAKGNYDFGISRVIKSLEPYNKKLGTDTWYYAKRCFLSLLENMSKHTIMLRDSVIQECVQFLEHCELHGRNIPAVIEQPLEEERMHVGKNTVTYESRQLKALIYEIIGWNI

SEQ ID NO: 16414 - protein, 618 aa, Homo sapiens
MAGLSGAQIPDGEFALAAECYEQLGQLHPELEQYRLYQAQALYKACLYAEATRVAFLLLDNPAYHSRVLRLQAAIKYSEGDLPGSRSLVEQLPSREGGEESGGENETDGQINLGCLLYKEGQYEAACSKFFAALQASGYQPDLSYNLALAYYSSRQYASALKHIAEIIERGIRQHPELGVGMTTEGIDVRSVGNTLVLHQTALVEAFNLKAAIEYQLRNYEAAQEALTDMPPRAEEELDPVTLHNQALMNMDARPTEGFEKLQFLLQQNPFPPETFGNLLLLYCKYEYFDLAADVLAENAHLIYKFLTPYLYDFLDAVITCQTAPEEAFIKLDGLAGMLTEVLRKLTIQVQEARHNRDDEAIKKAVNEYDETMEKYIPVLMAQAKIYWNLENYPMVEKIFRKSVEFCNDHDVWKLNVAHVLFMQENKYKEAIGFYEPIVKKHYDNILNVSAIVLANLCVSYIMTSQNEEAEELMRKIEKEEEQLSYDDPDKKMYHLCIVNLVIGTLYCAKGNYDFGISRVIKSLEPYNKKLGTDTWYYAKRCFLSLLENMSKHTIMLRDSVIQECVQFLEHCELHGRNIPAVIEQPLEEERMHVGKNTVTYESRQLKALIYEIIGWNI

SEQ ID NO: 16415 - protein, 155 aa, Homo sapiens
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPFPQVPSKHCFEVPWPVSTLALSFMSPKPPQPAPLPDSE

SEQ ID NO: 16416 - protein, 285 aa, Homo sapiens [sequence omitted]

SEQ ID NO: 16417 - protein, 200 aa, Homo sapiens
MPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGPLACLHSCIILHVTEATPTSPSPRLRVEGPILSSPRTLQRAGTSWDLGSSICLRPDEGAPVPHRAGPCIYPLVGDIVW

SEQ ID NO: 16418 - protein, 246 aa, Homo sapiens
MPLRILDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQVRWLKNLIQLEPWKGHKELLGRHRV

SEQ ID NO: 16419 - protein, 519 aa, Homo sapiens
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLQGQRGGICAPPLSPGALQPLPHAELAPSGLPSLRCPRSTALRSPGLSPLLHYPSCHRSHPNQPLSQTQSRRPHPLKPQDPSKGWDILGLGLQHLSQAR

SEQ ID NO: 16420 - protein, 151 aa, Homo sapiens
MEGQRQESHATLTLAQAHFNNGEYAEAEALYSAYIRRCACAASSDESPGSKCSPEDLATAYNNRGQIKYFRVDFYEAMDDYTSAIEVQPNFEVPYYNRGLILYRLGYFDDALEDFKKVLDLNPGFQDATLSLKQTILDKEEKQRRNVAKNY

SEQ ID NO: 16421 - protein, 262 aa, Homo sapiens
MASFGWKRKIGEKVSKVTSQQFEAEAADEKDVVDNDEGNWLHAIKRRKEILLEGCAEKSKQLKDEGASLAENKRYREAIQKWDEALQLTPNDATLYEMKSQVLMSLHEMFPAVHAAEMAVQQNPHSWESWQTLGRAQLGLGEIILAIRSFQVALHIYPMNPEIWKEDLSWARTLQEQQKVAQRIKKSEAPAEVTHFSPKSIPDYDFESDEIVAVCAAIAEKEKTVSANKTMVIVSASGAIETVTEKEDGATPPDGSVFIKAR

SEQ ID NO: 16422 - protein, 566 aa, Homo sapiens
MLQRSPRAGPSRAQGRREAAETGGPTTQEGVACGVHQLATLLMELDSEDEASRLLAADALYRLGRLEETHKALLVALSRRPQAAPVLARLALLQLRRGFFYDANQLVKKLVQSGDTACLQPTLDVFCHEDRQLLQGHCHARALAILRARPGGADGRVHTKEAIAYLSLAIFAAGSQASESLLARARCYGFLGQKKTAMFDFNTVLRAEPGNVQALCGRALVHLALDQLQEAVDDIVSALKLGPGTVVPELRSLKPEAQALITQGLYSHCRALLSQLPDTGAPLEDKDTQGLLAVGEALIKIDSGQPHWHLLLADILMAQGSYEEAGTHLEKALHRAPTSEAARARLGLLQLKKGDVPGAARDLQSLAEVDAPDLSCLLHLLEASERQSLAQAAAQEAGTLLDAGQPRQALGYCSLSVLASGSSACHLRLRATCLAELQEFGRALRDLDHVLQEALGDGDLPRRAEDFCRQGRLLLSLGDEAAAAGAFAQALKLAPSLAQNSLCRQPGRAPTARMFLLRGQCCLEEQRHAEAWTAVESGLLVDPDHRGLKRLKARIRREASSGCWLQ

SEQ ID NO: 16423 - protein, 189 aa, Homo sapiens
MGTPNDQAVLQAIFNPDTPFGDIVGLDLGEEAEKEEREEDEVFPQAQLEQSKALELQGVMAAEAGDLSTALERFGQAICLLPERASAYNNRAQARRLQGDVAGALEDLERAVELSGGRGRAARQSFVQRGLLARLQGRDDDARRDFERAARLGSPFARRQLVLLNPYAALCNRMLADMMGQLRRPRDSR

SEQ ID NO: 16424 - protein, 130 aa, Homo sapiens
MAAEAGDLSTALERFGQAICLLPERASAYNNRAQARRLQGDVAGALEDLERAVELSGGRGRAARQSFVQRGLLARLQGRDDDARRDFERAARLGSPFARRQLVLLNPYAALCNRMLADMMGQLRRPRDSR

SEQ ID NO: 16425 - protein, 1564 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRALKLMSTSNTWCDLGINYYRQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 16426 - protein, 95 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDD

SEQ ID NO: 16427 - protein, 411 aa, Homo sapiens
MAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGYVKGIYSFGLMETNFYDQAEKLAKEALSINPTDAWSVHTVAHIHEMKAEIKDGLEFMQHSETFWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 16428 - protein, 469 aa, Homo sapiens
MAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETFWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 16429 - protein, 420 aa, Homo sapiens
MDSSPSLPLIRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFLLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAVSDGGPGRGWGSLGVSQTSRKSGTCDILRDRIDWGRGGGQERTNQRAGAGEALLAEQPGKTREEEAFVVPGILTGRYRTAALQWREVEGGA

SEQ ID NO: 16430 - protein, 578 aa, Homo sapiens
MGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 16431 - protein, 581 aa, Homo sapiens
MAFLTTWKEAASGKSDRRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 16432 - protein, 613 aa, Homo sapiens
MGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFLLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 16433 - protein, 577 aa, Homo sapiens
MTSAGGAPGALPAGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 16434 - protein, 112 aa, Homo sapiens
MKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDE

SEQ ID NO: 16435 - protein, 221 aa, Homo sapiens
MKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 16436 - protein, 522 aa, Homo sapiens
MSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYASESKDMKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 16437 - protein, 583 aa, Homo sapiens
MAGSEQQRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYASESKDMKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 16438 - protein, 276 aa, Homo sapiens
MHAPFRISCQVVWLFKIYLLMCQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 16439 - protein, 76 aa, Homo sapiens
MAGSEQQRPRRRDDGDSDAAAAAAAPLQDAELALAGINMLLNNGFRESDQLFKQYRKSFLTSEKTSALPGETQRRL

SEQ ID NO: 16440 - protein, 876 aa, Homo sapiens
MAEEEGRLHSVQGLLSLQDLQNVNTPLMRKLARLKLGLVEMALDMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPATTCQFLALSQSCSASETMRDVLLAATANTSSSQLAALLQLQHQLRCQDRTTTSLGARVEQRLAAVSKAWQNLCVTEQHFNLLNEMPPTFWILFLHLSGDRSRLYGAAYEKPKFITAAKGKVQAVGGSCKVMRLAISPTAFSHLLACAQQFRKQTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVADRHLLELPLEGLSVFDEGTISSVSREFSLQMLWNRLHKEETEGGVKKEGRSRDPKKRSLAKKGRKGSIPRTIPPDCIIVDSDNFKFVVDPYEEAQGPEMLTPVSITQDILERFQDTFTSRWAGHLGSKHFPSQAQWEQALGSCSGFFFYGMESFLSHILVERLVAMNLQECQVAVLLDLARSYQSLKRHMESVEHRRSVGRWEANWRNSASPSEDEWRRGGEPRRGFSDLEGQAAAAPKLRAPSHHAQLGPVWAAAPSHRVVQAWTCLPSAAGAPALASALGSAPLPTHPHLPAPIPSSQLALPFLGLSPALGAASARDPPPATSRKAAAWTSSSACLCAPWGLRRGWSCVSSRGQDKGGLPLAALVLSCLDQKTIQTVSLFLI

SEQ ID NO: 16441 - protein, 1530 aa, Homo sapiens
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKDPGKLIEMECLECESEALRLESKMKVYNRAAVEAQLDIIQRLDVALQRAVRLGDPRVIHVVCATQWNTCLPLLQHNLRHHLRKPLAGVADVLEKLDSLMTLLRCQVHMEMAQIEEDEDRLEPATEHLRKAARLDSLGLYRDRIQMASTRLRLCTTLYQAPERAEDKAIMAVEQAKKATPKDSVRKKRALLVNAGLALAPDAFQIVLDSENEAKVSTGKNRGRFTYLCAKAWHHTVSVDKAAGHLRRLGNENDKERIQIWAELAKVARKQGVWDVCRTASRFCLLYDNVKVKKLRLRRGKKKRGRDGSVQDTWSQPEVVLQRQVCPDLLRKFAEVGFIHAEATVHLLRSEGVELNDRAIPPEDLSQHPAGYVPEPPEVNAEWITYRTWIESLSRCAMNNWLRSAEIGQEIQEAWIVQNAVVYVLNHNHHLILAGRQKELVDALYHLLSIVKATGHSGDPVMLVTLCNTLARGLIISWIPVQAAEKSRKFMRPNAFHSPLDAGATSEIKTAVEVCEFALNLTNGSAPEETVPTGTRQQLIATWVKAKQLLQQQIGPRLGTEEQGTNEDVSSVTRVLVALEMYSCNGLGLMDFTVPSLAQLVKMASECNWSDPLVELQTLTRLTHFAHAARDHETTMACAHRALEMGIKYLKKFGPEESRLVAEMLCTATAIQGRSIMENLKGRKQLRLVAAKAFTESARFGGIAGSSALVMLAARHYWNAWLPLLSSAVYRKKAKGALKRLIGIINKTEARKQEKGKTLLLHQWPTADFQGGGTTEGYFLPGAEDDLALRAALYGLLFHSHADQDDWEGGLKVLDEAVQVLPRTAHRLLIFKHMVIVKAKLGQNFSMEIQKFKAESEDYLARMWHRLALNSPSVSGELACYNNAIQALQKPEMEWQKVEYLMEFGQWLHHRHFPLEDVVFHLRWAVEILLAMKPPGDVPEPQPTPDGEYVAVEMPPRSPVSEAEEAVSLEQLRSVRQLEALARVHILLALVLSPGAEGYEDCCLAAYAFFRHIWQVSLMTAGKSVLENRPLAATSSHLLLPKKEKENERSKEKEKERSKEKENERSKEKDKEKGKEEKVKEPKQSQSPAPIKQLEDLPMSIEEWASYSCPEEVLSVLKQDRSDSTVNPSSIQKPTYSLYFLDHLVKALQKMCLHELTVPVLQLGVLISDSVVGSKGLSDLYHLRWVQLLFRSVISPKQNKNKQHVKVLIL

SEQ ID NO: 16442 - protein, 405 aa, Homo sapiens
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKVSGFMTLLPGDEALLTVQLDKRQRKEEQFTRPRPPGLRSVVGTLPSFLPVFCTVAVRWCLQFYTCPFLFTFLVATGPQHHSCF

SEQ ID NO: 16443 - protein, 2715 aa, Homo sapiens
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKDPGKLIEMECLECESEALRLESKMKVYNRAAVEAQLDIIQRLDVALQRAVRLGDPRVIHVVCATQWNTCLPLLQHNLRHHLRKPLAGVADVLEKLDSLMTLLRCQVHMEMAQIEEDEDRLEPATEHLRKAARLDSLGLYRDRIQMASTRLRLCTTLYQAPERAEDKAIMAVEQAKKATPKDSVRKKRALLVNAGLALAPDAFQIVLDSENEAKVSTGKNRGRFTYLCAKAWHHTVSVDKAAGHLRRLGNENDKERIQIWAELAKVARKQGVWDVCRTASRFCLLYDNVKVKKLRLRRGKKKRGRDGSVQDTWSQPEVVLQRQVCPDLLRKFAEVGFIHAEATVHLLRSEGVELNDRAIPPEDLSQHPAGYVPEPPEVNAEWITYRTWIESLSRCAMNNWLRSAEIGQEIQEAWIVQNAVVYVLNHNHHLILAGRQKELVDALYHLLSIVKATGHSGDPVMLVTLCNTLARGLIISWIPVQAAEKSRKFMRPNAFHSPLDAGATSEIKTAVEVCEFALNLTNGSAPEETVPTGTRQQLIATWVKAKQLLQQQIGPRLGTEEQGTNEDVSSVTRVLVALEMYSCNGLGLMDFTVPSLAQLVKMASECNWSDPLVELQTLTRLTHFAHAARDHETTMACAHRALEMGIKYLKKFGPEESRLVAEMLCTATAIQGRSIMENLKGRKQLRLVAAKAFTESARFGGIAGSSALVMLAARHYWNAWLPLLSSAVYRKKAKGALKRLIGIINKTEARKQEKGKTLLLHQWPTADFQGGGTTEGYFLPGAEDDLALRAALYGLLFHSHADQDDWEGGLKVLDEAVQVLPRTAHRLLIFKHMVIVKAKLGQNFSMEIQKFKAESEDYLARMWHRLALNSPSVSGELACYNNAIQALQKPEMEWQKVEYLMEFGQWLHHRHFPLEDVVFHLRWAVEILLAMKPPGDVPEPQPTPDGEYVAVEMPPRSPVSEAEEAVSLEQLRSVRQLEALARVHILLALVLSPGAEGYEDCCLAAYAFFRHIWQVSLMTAGKSVLENRPLAATSSHLLLPKKEKENERSKEKEKERSKEKENERSKEKDKEKGKEEKVKEPKQSQSPAPIKQLEDLPMSIEEWASYSCPEEVLSVLKQDRSDSTVNPSSIQKPTYSLYFLDHLVKALQKMCLHELTVPVLQLGVLISDSVVGSKGLSDLYHLRLAHACSELKLREAAARHEEAVGQVCVSELEQASCRKEIALKKEKNKEPLLEESLPALNEQTLPVQPGEIKPLDAKDKILKMNGETGRDLDGTSFPHLWMLKAEVLLEMNLYQPARLLLSEAYLAFQELDEPCAEAQCLLLLAQLANKEKNYGQAKKMIAQAQHLGGSEEFWYNSTLTLAEALLSMEHSGREATVCHIFQKLINAFKILKKERPNRLPLLEFMITDLEARCLSLRVRVAQHSAVTEPTECSLLLKEMDDGLLEIERKFIDCGCKENCVDVKLERAKIKRLRAQNEKDEEQKTAYYLEAYGLAQGAVAEEEGRLHSIQGLYGLAQGAMAEEEGRLHSVQGLLSLQDLQNVNTPLMRKLARLKLGLVEMALDMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPATTCQFLALSQSCSASETMRDVLLAATANTSSSQLAALLQLQHQLRCQDRTTTSLGARVEQRLAAVSKAWQNLCVTEQHFNLLNEMPPTFWILFLHLSGDRSRLYGAAYEKPKFITAAKGKVQAVGGSCKVMRLAISPTAFSHLLACAQQFRKQTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVADRHLLELPLEGLSVFDEGTISSVSREFSLQMLWNRLHKEETEGGVKKEGRSRDPKKRSLAKKGRKGSIPRTIPPDCIIVDSDNFKFVVDPYEEAQGPEMLTPVSITQDILERFQDTFTSRWAGHLGSKHFPSQAQWEQALGSCSGFFFYGMESFLSHILVERLVAMNLQECQVAVLLDLARSYQSLKRHMESVEHRRSVGRWEANWRNSASPSEDEWRRGGEPRRGFSDLEGQAAAAPKLRAPSHHAQLGPVWAAAPSHRVVQAWTCLPSAAGAPALASALGSAPLPTHPHLPAPIPSSQLALPFLGLSPALGAASARDPPPATSRKAAAWTSSSACLCAPWGLRRGWSCVSSRGQDKGGLPLAALVLSCLDQKTIQTVSLFLI

SEQ ID NO: 16444 - protein, 520 aa, Homo sapiens
MMKYYDLAKFTIYQIAEMDKGLSELSPMQQALIYSFCENHDKAIEVLDGISWNRAEMTMCALLAKVQMKAKRTKEAVEVLKKALDAISHSDKGPDATAISADCLYNLGLCYMEEGNLQMTYKLAITDLTTAISMDKNSYTAFYNRALCYTKIRELQMALTDYGIVLLLDATETVKLNTFLNRGLIYVELGQYGFALEDFKQAALISRTNGSLCHATAMCHHRINEFEEAVNFFTWALKINPCFLDAYVGRGNSYMEYGHDEATKQAQKDFLKALHINPAYIKARISFGYNLQAQGKFQKAWNHFTIAIDTDPKNYLAYEGRAVVCLQMGNNFAAMQDINAAMKISTTAEFLTNRGVIHEFMGHKQNAMKDYQDAITLNPKYSLAYFNAGNIYFHHRQFSQASDYFSKALKFDPENEYVLMNRAITNTILKKYEEAKEDFANVIESCPFWAAVYFNRAHFYYCLKQYELAEEDLNKALSLKPNDALVYNFRAKVRGKIGLIEEAMADYNQALDLEDYASVI

SEQ ID NO: 16445 - protein, 536 aa, Homo sapiens
MDKGLSELSPMQQALIYSFCENHDKAIEVLDGISWNRAEMTMCALLAKVQMKAKRTKEAVEVLKKALDAISHSDKGPDATAISADCLYNLGLCYMEEGNLQMAFDSFTKAVKANPDFAESFYQRGLCKVKLHKDSSILDFNRAITLNPKHYQAYLSRVAFYGLKGRYSKAILNCNKAIKIYPESVRAYLYRGVLKYYNKTYKLAITDLTTAISMDKNSYTAFYNRALCYTKIRELQMALTDYGIVLLLDATETVKLNTFLNRGLIYVELGQYGFALEDFKQAALISRTNGSLCHATAMCHHRINEFEEAVNFFTWALKINPCFLDAYVGRGNSYMEYGHDEATKQAQKDFLKALHINPAYIKARISFGYNLQAQGKFQKAWNHFTIAIDTDPKNYLAYEGRAVVCLQMGNNFAAMQDINAAMKISTTAEFLTNRGVIHEFMGHKQNAMKDYQDAITLNPKYSLAYFNAGNIYFHHRQFSQEESLGLAWSLSLDSFLRTGGATFSSGVNPLQTLHRRMSILSPLPPTCPRDEMDFTS

SEQ ID NO: 16446 - protein, 520 aa, Homo sapiens; identical to SEQ ID NO: 16444

SEQ ID NO: 16447 - protein, 843 aa, Homo sapiens
MATKKAGSRLETEIERCRSECQWERIPELVKQLSAKLIANDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGNLTRGVGRFRELLRAVETRTTQNLRMTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAISPTHVKSMQRLALILHQLGRYSLAEKILRDAVQVNSTAHEVWNGLGEVLQAQGNDAAATECFLTALELEASSPAVPFTIIPRVL

SEQ ID NO: 16448 - protein, 860 aa, Homo sapiens
MATKKAGSRLETEIERCRSECQWERIPELVKQLSAKLIANDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGNLTRGVGRFRELLRAVETRTTQNLRMTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGNSPEAYFHGFPSLFSVSSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAISPTHVKSMQRLALILHQLGRYSLAEKILRDAVQVNSTAHEVWNGLGEVLQAQGNDAAATECFLTALELEASSPAVPFTIIPRVL

SEQ ID NO: 16449 - protein, 418 aa, Homo sapiens
MTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGNQCSWIAFGEMLVDMGIQCI

SEQ ID NO: 16450 - protein, 330 aa, Homo sapiens
IPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGNSPEAYFHGFPSLFSVSSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAISPTHVKSMQRLALILHQLGRYSLAEKILRDAVQVNSTAHEVWNGLGEVLQAQGNDAAATECFLTALELEASSPAVPFTIIPRVL

SEQ ID NO: 16451 - protein, 239 aa, Homo sapiens
MQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPAPGPTSSPGPARLSEEQRRLVESTEVECYDSLTACLLQSELVNYERVREYCLKVLEKQQGNFKATYRAGIAFYHLGDYARALRYLQEARSREPTDTNVLRYIQLTQLKMNRCSLQREDSGAGSQTRDVIG

SEQ ID NO: 16452 - protein, 171 aa, Homo sapiens
MEKRLQEAQLYKEEGNQRYREGKYRDAVSRYHRALLQLRGLDPSLPSPLPNLGPQGPALTPEQENILHTTQTDCYNNLAACLLQMEPVNYERVREYSQKVLERQPDNAKALYRAGVAFFHLQDYDQARHYLLAAVNRQPKDANVRRYLQLTQSELSSYHRKEKQLYLGMFG

SEQ ID NO: 16453 - protein, 215 aa, Homo sapiens
MLNKEEELELLEALWSFSTSPAHSLLLPGRGGAGPIERRKPVSQAFSRPQQFLSRALLEFFGKSHPPPHRLFRKSLNVGLHYSHIPFLTTCLHFLRKRLQKGEVGLSVETSKPQVPVGGLSRKKVPQEPWATVMEKRLQEAQLYKEEGNQRYREGKYRDAVSRYHRALLQLRGLDPSLPSPLPNLGPQGPALTPEQENILHTTQTDCYNNLAVVK

SEQ ID NO: 16454 - protein, 140 aa, Homo sapiens
MEKRLQEAQLYKEEGNQRYREGKYRDAVSRYHRALLQLRGLDPSLPSPLPNLGPQGPALTPEQENILHTTQTDCYNNLAACLLQMEPVNYERVREYSQKVLERQPDNAKALYRAGVAFFHLQDYDQARHYLLAAVNRQPK

SEQ ID NO: 16455 - protein, 171 aa, Homo sapiens; identical to SEQ ID NO: 16452

SEQ ID NO: 16456 - protein, 2000 aa, Homo sapiens
MFRNSLKMLLTGGKSSRKNRSSDGGSEEPPDRRQSSVDSRQSRSGQGGISTESDCAFEPDYAVPPLPVSEGDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGCQTLPSRPRGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 16457 - protein, 1990 aa, Homo sapiens
MFRNSLKMLLTGGKSSRKNRSSDGGSEEPPDRRQSSVDSRQSRSGQGGISTESDCAFEPDYAVPPLPVSEGDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 16458 - protein, 155 aa, Homo sapiens
MSDSDLGEDEGLLSLAGKRKRRGNLPKESVKILRDWLYLHRYNAYPSEQEKLSLSGQTNLSVLQDEFLDVIYWFRQIIAVVLGVIWGVLPLRGFLGIAGFCLINAGVLYLYFSNYLQIDEEEYGGTWELTKEGFMTSFALFMVIWIIFYTAIHYD

SEQ ID NO: 16459 - protein, 465 aa, Homo sapiens
MENQEFLSSSAPSEVTDGQVSTEISTCSEVFQKPIVLRILDTHRELEESEDPEKHENPEEPEEVREQDQRDESEECDEPHESYEPHAPYAPHKPRDSYAPYELHGPHAAPKLLKAREPRQLRHTREPRKSREAKETELLPSAAVMISPSLITRAPPRPQLSFLGANPVSCDFVRKCFSSRKRTPNLSKPKKQWGTPDRKLFWGNQDPIRPVSQGALKAQLTKRLENLAQPKEVSCHYVPNRAQYYHSCGRESVIWEITPPALFRQPSKRIQRLSQPNGFKRQCLLNRPFSDNSARDSLRISDPSPRILQLSVAKGTDPNYHPSKKMQTKISLSTLSAIATPRIIELAHPRIKLEGLCYERQRSELPIRPVPPAAMIAKPSPRTIALAKSKSVHQDYLPDRDAHWPVSYATTHSKASPRIQELANPNKRAPVRIVYYDPDVFKTKPAALKAQCSQRIWELSQPLTR

SEQ ID NO: 16460 - protein, 105 aa, Homo sapiens
MAQGLIEVERKFLPGPGTEERLQELGGTLEYRVTFRDTYYDTPELSLMQADHWLRRREDSGWELKCPGAAGVLGPHTEYKELTAEPTIVAQLCKVCLHRRQHQPS

SEQ ID NO: 16461 - protein, 250 aa, Homo sapiens
  MOD_RES (1)..(1): Any amino acid
XYALPNASWCSDMLSLYQEFLEKTKSSGWIKLPSFKSNRDHIRGLKLPSGLAVSSDKGDCRIFTRCIQVEGQGFEYVIFFQPTQKKSVCLFQPGSYLEGPPGFAHGGSLAAMMDETFSKTAFLAGEGLFTLSLNIRFKNLIPVDSLVVMDVELDKIEDQKLYMSCIAHSSWKKSLPSNSHCACRRATASPACLLPPASPACLLPPASPACLLPPLPASCLLPPLPASCLLPPLPAWDPSKSREGSSSSNW

SEQ ID NO: 16462 - protein, 133 aa, Homo sapiens
MRDLSERRLGQPELKAEQQMPLEPVRARLSVGLACCCSHTTAEASSLEHGDKVFGQGFPSPLEEIKRLLKISRALQARSVPSTQEKAKCLSGEPGQPEGKGQETYPGPGKVEGKAEPAMRKDDVCPGMKCISG

SEQ ID NO: 16463 - protein, 133 aa, Homo sapiens; identical to SEQ ID NO: 16462

SEQ ID NO: 16464 - protein, 516 aa, Homo sapiens
MPSSTSPDQGDDLENCILRFSDLDLKDMSLINPSSSLKAELDGSTKKKYSFAKKKAFALFVKTKEVPTKRSFECKEKLWKCCRQLFTDQTSIHRHVATQHADEIYHQTASILKQLAVTLSTSKSLSSADEKNPLKECLPHSHDVSAWLPDISCFNPDELISGQGSEEGEVLLYYCYHDLEDPQWICAWQTALCQHLHLTGKIRIAAEGINGTVGGSKLATRLYVEVMLSFPLFKDDLCKDDFKTSKGGAHCFPELRVGVFEEIVPMGISPKKISYKKPGIHLSPGEFHKEVEKFLSQANQEQSDTILLDCRNFYESKIGRFQGCLAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 16465 - protein, 167 aa, Homo sapiens
MDLCLADSSVSAPAPHRQGIHLSPGEFHKEVEKFLSQANQEQSDTILLDCRNFYESKIGRFQGCLAPDIRKFSYFPSYVDKNLELFREKRVLMYCTGGIRCERGSAYLKAKGVCKEVFQLKGGIHKYLEEFPDGFYKGKLFVFDERYALSYNSDVVSGRSAQAQSPN

SEQ ID NO: 16466 - protein, 72 aa, Homo sapiens
MLSFPLFKDDLCKDDFKTSKGGAHCFPELRVGVFEEIVPMGISPKKISYKKPGMLAFRRLCFNSQGQNLIDK

SEQ ID NO: 16467 - protein, 167 aa, Homo sapiens; identical to SEQ ID NO: 16465

SEQ ID NO: 16468 - protein, 215 aa, Homo sapiens
MLSFPLFKDDLCKDDFKTSKGGAHCFPELRVGVFEEIVPMGISPKKISYKKPGIHLSPGEFHKEVEKFLSQANQEQSDTILLDCRNFYESKIGRFQGCLAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQLDTLP

SEQ ID NO: 16469 - protein, 112 aa, Homo sapiens
MYVFIMMAFPSSPECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 16470 - protein, 236 aa, Homo sapiens
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 16471 - protein, 743 aa, Homo sapiens
MLHFNRCHHLKKITQKCFSSIHVKTDKHAQRFLSRTFALAELRKSWYSTHSLVGDKNIILMGPPGAGKTTVGRIIGQKLGCCVIDVDDDILEKTWNMSVSEKLQDVGNEQFLEEEGKAVLNFSASGSVISLTGSNPMHDASMWHLKKNGIIVYLDVPLLDLICRLKLMKTDRIVGQNSGTSMKDLLKFRRQYYKKWYDARVFCESGASPEEVADKVLNAIKRYQDVDSETFISTRHVWPEDCEQKVSAKFFSEAVIEGLASDGGLFVPAKEFPKLSCGEWKSLVGATYVERAQILLERCIHPADIPAARLGEMIETAYGENFACSKIAPVRHLSGNQFILELFHGPTGSFKDLSLQLMPHIFAHCIPPSCNYMILVATSGDTGSAVLNGFSRLNKNDKQRIAVVAFFPENGVSDFQKAQIIGSQRENGWAVGVESDFDFCQTAIKRIFNDSDFTGFLTVEYGTILSSANSINWGRLLPQVVYHASAYLDLVSQGFISFGSPVDVCIPTGNFGNILAAVYAKMMGIPIRKFICASNQNHVLTDFIKTGHYDLRERKLAQTFSPSIDILKSSNLERHLHLMANKDGQLMTELFNRLESQHHFQIEKALVEKLQQDFVADWCSEGECLAAINSTYNTSGYILDPHTAVAKVVADRVQDKTCPVIISSTAHYSKFAPAIMQALKIKEINETSSSQLYLLGSYNALPPLHEALLERTKQQEKMEYQVCAADMNVLKSHVEQLVQNQFI

SEQ ID NO: 16472 - protein, 743 aa, Homo sapiens; identical to SEQ ID NO: 16471

SEQ ID NO: 16473 - protein, 766 aa, Homo sapiens
MAAEALAAEAVASRLERQEEDIRWLWSEVERLRDEQLNAPYSCQAEGPCLTREVAQLRAENCDLRHRLCSLRLCLAEERSRQATLESAELEAAQEAGAQPPPSQSQDKDMKKKKMKESEADSEVKHQPIFIKERLKLFEILKKDHQLLLAIYGKKGDTSNIITVRVADGQTVQGEVWKTTPYQVAAEISQELAESTVIAKVNGELWDLDRPLEGDSSLELLTFDNEEAQAVYWHSSAHILGEAMELYYGGHLCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIREEYHKRDFTEVLSPNMYNSKLWEASGHWQHYSENMFTFEIEKDTFALKPMNCPGHCLMFAHRPRSWREMPIRFADFGVLHRNELSGTLSGLTRVRRFQQDDAHIFCTVEQIEEEIKGCLQFLQSVYSTFGFSFQLNLSTRPENFLGEIEMWNEAEKQLQNSLMDFGEPWKMNPGDGAFYGPKIDIKIKDAIGRYHQCATIQLDFQLPIRFNLTYVSKDGDDKKRPVIIHRAILGSVERMIAILSENYGGKWPFWLSPRQVMVIPVGPTCEKYALQVSSEFFEEGFMADVDLDHSCTLNKKIRNAQLAQYNFILDRFLPSVWQEAWL

SEQ ID NO: 16474 - protein, 1609 aa, Homo sapiens
MFPKSNLTVTCWVWRSMRKLFLLLSLLLSHAAHLEGKKDNQFIWKPGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQNAQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 16475 - protein, 1578 aa, Homo sapiens
MHNTADEVVLYHKLAGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQNAQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 16476 - protein, 333 aa, Homo sapiens
MVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQQVFGTITNELYGASVQMALMSQEAAPLRPVLLPFGSAFQPAENLSPTVHRVESVVVRRAIQR

SEQ ID NO: 16477 - protein, 353 aa, Homo sapiens
MAAPAQQTTQPGGGKRKGKAQYVLAKRARRCDAGGPRQLEPGLQGILITCNMNERKCVEEAYSLLNEYGDDMYGPEKFTDKDQQPSGSEGEDDDAEAALKKEVGDIKASTEMRLRRFQSVESGANNVVFIRTLGIEPEKLVHHILQDMYKTKKKKTRVILRMLPISGTCKAFLEDMKKYAETFLEPWFKAPNKGTFQIVYKSRNNSHVNREEVIRELAGIVCTLNSENKVDLTNPQYTVVVEIIKAVCCLSVVKDYMLFRKYNLQEVVKSPKDPSQLNSKQGNGKEAKLESADKSDQNNTAEGKNNQQVPENTEELGQTKPTSNPQVVNEGGAKPELASQATEGSKSNENDFS

SEQ ID NO: 16478 - protein, 353 aa, Homo sapiens; identical to SEQ ID NO: 16477

SEQ ID NO: 16479 - protein, 439 aa, Homo sapiens
MAAMLPLLDSGCSREAGQEAGLGRVSLHPFHDCRPALGPGAARNEASRPARGGRRSYPTSPVRAGDRRGRQQQRRNVSLSSQFAHTMAAPAQQTTQPGGGKRKGKAQYVLAKRARRCDAGGPRQLEPGLQGILITCNMNERKCVEEAYSLLNEYGDDMYGPEKFTDKDQQPSGSEGEDDDAEAALKKEVGDIKASTEMRLRRFQSVESGANNVVFIRTLGIEPEKLVHHILQDMYKTKKKKTRVILRMLPISGTCKAFLEDMKKYAETFLEPWFKAPNKGTFQIVYKSRNNSHVNREEVIRELAGIVCTLNSENKVDLTNPQYTVVVEIIKAVCCLSVVKDYMLFRKYNLQEVVKSPKDPSQLNSKQGNGKEAKLESADKSDQNNTAEGKNNQQVPENTEELGQTKPTSNPQVVNEGGAKPELASQATEGSKSNENDFS

SEQ ID NO: 16480 - protein, 507 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEGKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGERGTLWQCKE

SEQ ID NO: 16481 - protein, 41 aa, Homo sapiens
MCDIEEATNQLLDVNLHENQKSVQVTESDLGSESELLVTIG

SEQ ID NO: 16482 - protein, 123 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGK

SEQ ID NO: 16483 - protein, 507 aa, Homo sapiens; identical to SEQ ID NO: 16480

SEQ ID NO: 16484 - protein, 507 aa, Homo sapiens; identical to SEQ ID NO: 16480

SEQ ID NO: 16485 - protein, 521 aa, Homo sapiens; identical to SEQ ID NO: 14833

SEQ ID NO: 16486 - protein, 383 aa, Homo sapiens
MTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 16487 - protein, 82 aa, Homo sapiens
MEASVLSPTSWEKRRAWLRQSRNWQTQVLEEEAAAALQDVPDPEPSSLDDVFQEGNPINKIEDWLQDCGYSEEGFSEEAGQF

SEQ ID NO: 16488 - protein, 48 aa, Homo sapiens
MEASVLSPTSWEKRRAWLRQSRNWQTQVLEEEAAAALQDVPDPEPSSL

SEQ ID NO: 16489 - protein, 45 aa, Homo sapiens
MSDKPDLSEVEKFDRSKLKKTNTEEKNTLPSKETIQQEKECVQTS

SEQ ID NO: 16490 - protein, 195 aa, Homo sapiens
MPNFLGLHRARSFTVLCFWSTADVLNASGPRRQWHPLASCSSWSRPQSQGSTPGVLCKTGMGREPIPETQCHFANSMCSLHVSVPYFGNSPNISNFFRWSLALSPRQWCDLGSLQPPSPRFKGFSCLSLPSSWDYRRAPSPANFCILVEMGFHHVGQADLELLTSADLPTSASQSAGITGVSHHAWPQTLSLLLY

SEQ ID NO: 16491 - protein, 264 aa, Homo sapiens
MAPTGLLVAGASFLAFRGLHWGLRRLPTPESAARDRWQWWNLCVSLAHSLLSGTGALLGLSLYPQMAADPIHGHPRWALVLVAVSVGYFLADGADLLWNQTLGKTWDLLCHHLVVVSCLSTAVLSGHYVGFSMVSLLLELNSACLHLRKLLLLSRQAPSLAFSVTSWASLATLALFRLVPLGWMSLWLFRQHHQVPLALVTLGGIGLVTVGIMSIILGIRILVNDVLQSRPHPPSPGHEKTRGTRTRRDNGPVTSNSSTLSLKD

SEQ ID NO: 16492 - protein, 1186 aa, Homo sapiens
  MOD_RES (1)..(1): Any amino acid
XCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 16493 - protein, 370 aa, Homo sapiens
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 16494 - protein, 325 aa, Homo sapiens
MAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPPDYQWYALDQLPPDVQHKANGLSSVKKVHP

SEQ ID NO: 16495 - protein, 325 aa, Homo sapiens; identical to SEQ ID NO: 16494

SEQ ID NO: 16496 - protein, 369 aa, Homo sapiens
MNKNEKHDDKLVMFTNQSEDSERCESMELDKKIQDLIERNASPHPKRFTPEAMPTHRNLCSLKTPGKTASMAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPVYPQ

SEQ ID NO: 16497 - protein, 342 aa, Homo sapiens
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQVNGIVILADYKGVSLSKASHFGPFIAKKVIGILQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILGQTLLPEGLTSDAQCDDSLRAVKSQLYSCY

SEQ ID NO: 16498 - protein, 342 aa, Homo sapiens; identical to SEQ ID NO: 16497

SEQ ID NO: 16499 - protein, 279 aa, Homo sapiens
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILG

SEQ ID NO: 16500 - protein, 102 aa, Homo sapiens
MRASPCISQPAASWHPRPSALRPTAGSGPDTRTPGTVEDGSAPCPAFRSPAVSPCGEEPCCFQISPAEETLELGRLVSPGCHKSSAPQERRLDPRARCVVHI

SEQ ID NO: 16501 - protein, 124 aa, Homo sapiens
MRASPCISQPAASWHPRPSALRPTAGSGPDTRTPGTVEDGSAPCPAFRSPAVSPCGEEPCCFQISPAEETLELGRLVSPGNCDTLSPRAAGFYACHVRSLIPCRSTKGRWPLTASAAGLSSFSG

SEQ ID NO: 16502 - protein, 376 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHK

SEQ ID NO: 16503 - protein, 376 aa, Homo sapiens; identical to SEQ ID NO: 16502

SEQ ID NO: 16504 - protein, 376 aa, Homo sapiens; identical to SEQ ID NO: 16502

SEQ ID NO: 16505 - protein, 517 aa, Homo sapiens
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRPRQFNDLWVRIEDSTTASPPPLPLQPTHSSGTAKPPFQLSDQLQQQDPPGPASSSAPTLGLLPAIATTIAVCFLLHSLGPS

SEQ ID NO: 16506 - protein, 184 aa, Homo sapiens
MTSFEDADTEETVTCLQMTVYHPGQLQCGIFQSISFNREKLPSSEVVKFGRNSNICHYTFQDKQVSRVQFSLQLFKKFNSSVLSFEIKNMSKKTNLIVDSRELGYLNKMDLPYRCMVRFGEYQFLMEKEDGESLEFFETQFILSPRSLLQENNWPPHRPIPEYGTYSLCSSQSSSPTEMDENES

SEQ ID NO: 16507 - protein, 84 aa, Homo sapiens
MTSFEDADTEETVTCLQMTVYHPGQLQCGIFQSISFNREKLPSSEVVKFGRNSNICHYTFQDKQVSRVQFSLQLFKIQQLSSLL

SEQ ID NO: 16508 - protein, 184 aa, Homo sapiens; identical to SEQ ID NO: 16506

SEQ ID NO: 16509 - protein, 183 aa, Homo sapiens
MEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFAQGDNGVSGE

SEQ ID NO: 16510 - protein, 546 aa, Homo sapiens
MAAGSTTLRAVGKLQVRLATKTEPKKLEKYLQKLSALPMTADILAETGIRKTVKRLRKHQHVGDFARDLAARWKKLVLVDRNTGPDPQDPEESASRQRFGEALQEREKAWGFPENATAPRSPSHSPEHRRTARRTPPGQQRPHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAVADSAGPKTVPSHVFSELWDPSEAWMQANYDLLSAFEAMTSQANPEALSAPTLQEEAAFPGRRVNAKMPVYSGSRPACQLQVPTLRQQCLRVPRNNPDALGDVEGVPYSALEPVLEGWTPDQPYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 16511 - protein, 586 aa, Homo sapiens
MQAGARFQRRRRQLQQQQPRRRQPLLWPMDAEPPPPPPWVWMVPGSAGLLRLSAGVVVPPVLLASAPPPAAPLLPGLPGWPAPSEPVLPLLPLPSAPDSAAAAAAHPFPALHGQWLFGGHSPSLGLPPSSTVELVPVFPHLCPSALATPIGKSWIDKRIPNCKIFFNNSFALDSTWIHPEESRFFHGHEKPRLLANQVAVSLSRPAPASRPLPTVVLAPQPIPGGCHNSLKVTSSPAIAIATAAAAAMVSVDPENLRGPSPSSVQPRHFLTLAPIKIPLRTSPVSDTRTERGRVARPPALMLRAQKSRDGDKEDKEPPPMLGGGEDSTARGNRPVASTPVPGSPWCVVWTGDDRVFFFNPTMHLSVWEKPMDLKDRGDLNRIIEDPPHKRKLEAPATDNSDGSSSEDNREDQDVKTKRNRTEGCGSPKPEEAKREDKGTRTPPPQILLPLEERVTHFRDMLLERGVSAFSTWEKELHKIVFDPRYLLLNSEERKQIFEQFVKTRIKEEYKEKKSKLLLAKEEFKKLLEESKVSPRTTFKEFAEKYGRDQRFRLVQKRKDQEHFFNQFILILKKRDKENRLRLRKMR

SEQ ID NO: 16512 - protein, 167 aa, Homo sapiens
MDRGRPAGSPLSASAEPAPLAAAIRDSRPGRTGPGPAGPGGGSRSGSGRPAAANAARERSRVQTLRHAFLELQRTLPSVPPDTKLSKLDVLLLATTYIAHLTRSLQDDAEAPADAGLGALRGDGYLHPVKKWPMRSRLYIGATGQFLKHSVSGEKTNHDNTPTDSQP

SEQ ID NO: 16513 - protein, 3859 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 16514 - protein, 316 aa, Homo sapiens
MGESAAATASLFQRRRRGRGGRVTFPGGLKGSARFLSFGPPFPAPPAPPFPAAPGPWLRRPLFSLKLSDTEDVFPRRAGPLEVPADSRVFVQAALARPSPRWGLALHRCSVTPSSRPAPGPALALLREGCPADTSVAFPPPPPPSPGAARPARFSFRLRPVFNASVQFLHCQLSRCRRLRGVRRAPAPLTPPPPPPPSRCLPQDEACADTGSGSAEGLAADGPHLHTLTQPIVVTVPRPPPRPPKSVPGRAVRPEPPAPAPAALEPAPVVALVLAAFVLGAALAAGLGLVCAHSAPHAPGPPARASPSGPQPRRSQ

SEQ ID NO: 16515 - protein, 199 aa, Homo sapiens
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 16516 - protein, 199 aa, Homo sapiens; identical to SEQ ID NO: 16515

SEQ ID NO: 16517 - protein, 199 aa, Homo sapiens; identical to SEQ ID NO: 16515

SEQ ID NO: 16518 - protein, 199 aa, Homo sapiens; identical to SEQ ID NO: 16515

SEQ ID NO: 16519 - protein, 221 aa, Homo sapiens
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPGRSCRTRHLPLVERTNVPHHGLYEKK

SEQ ID NO: 16520 - protein, 839 aa, Homo sapiens [sequence omitted]

SEQ ID NO: 16521 - protein, 596 aa, Homo sapiens
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 16522 - protein, 499 aa, Homo sapiens
MWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPPASASSSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 16523 - protein, 493 aa, Homo sapiens
MWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 16524 - protein, 118 aa, Homo sapiens [sequence omitted]

SEQ ID NO: 16525 - protein, 253 aa, Homo sapiens
MLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 16526 - protein, 300 aa, Homo sapiens
MLPLLAALLAAACPLPPVRGGAADAPGLLGVPSNASVNASSADEPIAPRLLASAAPGPPERPGPEEAAAAAAPCNISVQRQMLSSLLVRWGRPRGFQCDLLLFSTNAHGRAFFAAAFHRVGPPLLIEHLGLAAGGAQQDLRLCVGCGWVRGRRTGRLRPAAAPSAAAATAGAPTALPAYPAAEPPGPLWLQGEPLHFCCLDFSLEELQGEPGWRLNRKPIESTLVACFMTLVIVVWSVAALIWPVPIIAGFLPNGMEQRRTTASTTAATPAAVPAGTTAAAAAAAAAAAAAAVTSGVATK

SEQ ID NO: 16527 - protein, 161 aa, Homo sapiens
MAKEEPQSISRDLQELQKKLSLLIDSFQNNSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRPLTQQNTSCDFLPAMKSAEFEGLYQE

SEQ ID NO: 16528 - protein, 161 aa, Homo sapiens; identical to SEQ ID NO: 16527

SEQ ID NO: 16529 - protein, 185 aa, Homo sapiens
MAKEEPQSISRDLQELQKKLSLLIDSFQNNSKLPQHSRISLDSDDGVSRLGSAGSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRPLTQQNTSCDFLPAMKSAEFEGLYQE

SEQ ID NO: 16530 - protein, 294 aa, Homo sapiens
MAAGRLLLYTGLSLALCALGMLAVAICSDHWYETDARKHRDRCKAFNTRRVDPGFIYNNNNNLPLRASRSRLDRWEGKLLRARNRRQLFAMSPADECSRQYNSTNMGLWRKCHRQGFDPEIAALIRKGEIERCTYIKYHYSSATIPRNLTFNITKTIRQDEWHALHLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 16531 - protein, 350 aa, Homo sapiens
MNLRGLFQDFNPSKFLIYACLLLFSVLLALRLDGIIQWSYWAVFAPIWLWKLMVIVGASVGTGVWARNPQYRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVVCVPLWILMSFLCLVVLYYIVWSVLFLRSMDVIAEQRRTHITMALSWMTIVVPLLTFEILLVHKLDGHNAFSSIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 16532 - protein, 291 aa, Homo sapiens
MNLRGLFQDFNPRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVVCVPLWILMSFLCLVVLYYIVWSVLFLRSMDVIAEQRRTHITMALSWMTIVVPLLTFEILLVHKLDGHNAFSSIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 16533 - protein, 172 aa, Homo sapiens
MSFLCLVVLYYIVWSVLFLRSMDVIAEQRRTHITMALSWMTIVVPLLTFEILLVHKLDGHNAFSSIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 16534 - protein, 417 aa, Homo sapiens
MGPRQGRWWLLLWLPPLATLPVRGEAAAAALSVRRCKALKEKDLIRTSESDCYCYNQNSQVEWKYIWSTMQVKITSPGLFRIVYIAERHNCQYPENILSFIKCVIHNFWIPKESNEITIIINPYRETVCFSVEPVKKIFNYMIHVNRNIMDFKLFLVFVAGVFLFFYARTLSQSPTFYYSSGTVLGVLMTLVFVLLLVKRFIPKYSTFWALMVGCWFASVYIVCQLMEDLKWLWYENRIYVLGYVLIVGFFSFVVCYKHGPLADDRSRSLLMWMLRLLSLVLVYAGVAVPQFAYAAIILLMSSWSLHYPLRACSYMRWKMEQWFTSKELVVKYLTEDEYREQADAETNSALEELRRACRKPDFPSWLVVSRLHTPSKFADFVLGGSHLSPEEISLHEEQYGLGGAFLEEQLFNPSTA

SEQ ID NO: 16535 - protein, 273 aa, Homo sapiens
MERREHLTLTFHSPEVPKIKGNRKYQRPTVPAKKHPSASMSCQRQQQLMDQAHIYIRTLCGSLCSFSLLMLIAMSPLNWVQFLVIKNGLELYAGLWTLCNHELCWSHTPKPPYYLQYSRAFFLISVFTILTGLGWLFSSWILNRGSMTTNLDLKVSMLSFISATCLLLCLNLFVAQVHWHTRDAMESDLLWTYYLNWCSDIFYMFAGIISLLNYLTSRSPACDENVTVIPTERSRLGVGPVTTVSPAKDEGPRSEMESLSVREKNLPKSGLWW

SEQ ID NO: 16536 - protein, 194 aa, Homo sapiens
MKGLYQAAGRILVTLGILSVCSGVIAFFPVFSYKPWFTGWSVRIACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 16537 - protein, 150 aa, Homo sapiens
ACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 16538 - protein, 291 aa, Homo sapiens
MARSYGGRVLAAMTLLGIAAAVLAALGAQLLFQLQAGRAELRGLRAEGLGQELGAGPGLPEDAAGTLLPLAAALAALVLVLGFTCLLLAALCGHLGAELARGPGPRRSDWFLYDCRLLRHVALGLFCCGISVYLAALSIYALLLFEIETGAAAASILGSGTLVLVAVLTHTLLRAARAARRGLHELSPPSFEDDLARPAEVSKASPRAQPQQGIHRRTPYSTCPEPGDPFGSMATATAPAALEGGWESSLPASRMHRTLSAGLGHWDGVTHEMRRMLGHRPGSMGKDSTLV

SEQ ID NO: 16539 - protein, 351 aa, Homo sapiens
MASGRLIKFVVFELLEFAAFSIPTLVITEQFATAYQGTRARSDNTHYWLIISCSIAYVALVTLLIWVPVKVILHKKRYIYRKIKGWRPVLMMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMVRVAGHPNVYKSSWLYPVYIFSFISLLRITFTPQNPLLNSLSVLLQDLPFVFVRLGLIIALGTITPVLGLCKNILVTLSYIYFNYLTRIRIFSAFEMSPF

SEQ ID NO: 16540 - protein, 176 aa, Homo sapiens
MAAAPAVCASQGSPPGAPSAPAAAPAPAAGLGRCRMALLLAVALDVAGMAALLTGVFAQLQVRGRDFGDLLIYSGALLVFLSLLGWILWYTGNIEISRQELERDYGLRPSALARLARKLSRRWSAPAAAGQRPAPGSRRARRAARAPPPPAAGSRRVRLQLATLEAGPGAAGAGSE

SEQ ID NO: 16541 - protein, 195 aa, Homo sapiens
MRVGTWICLPGRPGRCRKQHDLGNCPEVPGIFKTLALSPGAPDMMQQPRVETDTIGAGEGPQQAVPWSAWVTRHGWVRWWVSHMPPSWIQWWSTSNWRQPLQRLLWGLEGILYLLLALMLCHALFTTGSHLLSSLWPVVAAVWRHLLPALLLLVLSALPALLFTASFLLLFSTLLSLVGLLTSMTHPGDTQDLDQ

SEQ ID NO: 16542 - protein, 254 aa, Homo sapiens
MTRLCLPRPEAREDPIPVPPRGLGAGEGSGSPVRPPVSTWGPSWAQLLDSVLWLGALGLTIQAVFSTTGPALLLLLVSFLTFDLLHRCTRHDAAAASGDRYHRGWRGATAGSALVSLGHEAWLGALVGEPHAPELDPVVEHLELAATAAAPAVGSGGDTLPAAGTDVVPCTLHHWLPPAELLVACRGRGVAPPATGSPAAGAQCSACPPLHGLLPAALLHTAEPCGPPHLHDSPRRHSGFGSIEGQPHPTACVC

SEQ ID NO: 16543 - protein, 152 aa, Homo sapiens
MMQQPRVETDTIGAGEGPQQAVPWSAWVTRHGWVRWWVSHMPPSWIQWWSTSNWRQPLQRLLWGLEGILYLLLALMLCHALFTTGSHLLSSLWPVVAAVWRHLLPALLLLVLSALPALLFTASFLLLFSTLLSLVGLLTSMTHPGDTQDLDQ

SEQ ID NO: 16544 - protein, 322 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 16545 - protein, 322 aa, Homo sapiens; identical to SEQ ID NO: 16544

SEQ ID NO: 16546 - protein, 219 aa, Homo sapiens
MAAEDREMMEARGAGESCPTFPKMVPGDSKSEGKPRAYLEAESQKPDSSYDYLEEMEACEDGGCQGPLKSLSPKSCRATKGQAGDGPKPAELPPTPGTERNPEMELEKVRMEFELTRLKYLHEKNQRQRQHEVVMEQLQRERQHEVVMEQLQQEAAPRLFSGGLQNFLLPQNQFAMFLYCFIFIHIIYVTKEMVFFLFAKHYLFCIAAILLCLIKTFWS

SEQ ID NO: 16547 - protein, 439 aa, Homo sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEQKYWEALNSEQWDPEDVNLEGSKENVELLGSQVHQDSVRTAHLSDDD

SEQ ID NO: 16548 - protein, 113 aa, Homo sapiens
MFILFPVCGSKFKSNSDREARERKRRRQLRASVFALALPLSLGPCWALWVAVPKASATIRGPQRRLLASLLQENTEILGYLLGSVAAFGSWASRIPPLSRIVRPGVGMGLWVT

SEQ ID NO: 16549 - protein, 428 aa, Homo sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 16550 - protein, 396 aa, Homo sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAAVPPGCQVTGRRAPEMRPCRTPRRTLPFRSSGPGCLPAAPLRSPPSTPTWSGTLKM

SEQ ID NO: 16551 - protein, 475 aa, Homo sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIAPPPTLGITTQHEIWRGQMSKPSQSPSRSPSGHWRAAAQRQVLGTEMCRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 16552 - protein, 438 aa, Homo sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEKYWEALNSEQWDPEDVNLEGSKENVELLGSQVHQDSVRTAHLSDDD

SEQ ID NO: 16553 - protein, 158 aa, Homo sapiens
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 16554 - protein, 276 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLIISACARWFMGEILASVFTCSLMITVAYVKSLFLSLASYFKTTACARFVKI

SEQ ID NO: 16555 - protein, 232 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVRIFRKKKRICHSFSSLFNLSTSKSWLHGSIFGDINSSPSEDNWLKGTRRLDTDHCNGNETRLLQEVFFQAILLAVCLIISACARWFMGEILASVFTCSLMITVAYVKSLFLSLASYFKTTACARFVKI

SEQ ID NO: 16556 - protein, 99 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMY

SEQ ID NO: 16557 - protein, 92 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNP

SEQ ID NO: 16558 - protein, 221 aa, Homo sapiens
MGTLVAKLLLPTLSSLAFLPTVSIAAKRRFHMEAMVYLFTLFFVALHHACNGPGLSVLCFMRHDILEYFSVYGTALSMWVSLMALADFDEPKRSTFVMFGVLTIAVRIYHDRWGYGVYSGPIGTAILIIAAKWLQKMKEKKGLYPDKSVYTQQIGPGLCFGALALMLRFFFEDWDYTYVHSFYHCALAMSFVLLLPKVNKKAGSPGTPAKLDCSTLCCACV

SEQ ID NO: 16559 - protein, 184 aa, Homo sapiens
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACPLPLLSPAGGSTTLYNCSTCKGTEVSCWPRKRCFPGSQDLWEAKILLLSIFGAFLLLGVLSLLVESHHLQAKSGL

SEQ ID NO: 16560 - protein, 203 aa, Homo sapiens
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACRGSTTLYNCSTCKGTEVSCWPRKRCFPGSLGSQDSAPLHLRSFPASGCSEPPGGVPPPPSKKWLVKTLKTSQPPALRGMHSQLPHPLEGNQSAP

SEQ ID NO: 16561 - protein, 584 aa, Homo sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLAGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 16562 - protein, 904 aa, Homo sapiens
MPQLLRNVLCVIETFHKYASEDSNGATLTGRELKQLIQGEFGDFFQPCVLHAVEKNSNLLNIDSNGIISFDEFVLAIFNLLNLCYLDIKSLLSSELRQVTKPEKEKLDDVDVQATTGDGQWTVGTSPTQEKRMLPSGMASSSQLIPEESGAVGNNRVDPWREAKTHNFPGEASEHNDPKNKHLEGDEQSQEVAQDIQTTEDNEGQLKTNKPMAGSKKTSSPTERKGQDKEISQEGDEPAREQSVSKIRDQFGEQEGNLATQSSPPKEATQRPCEDQEVRTEKEKHSNIQEPPLQREDEPSSQHADLPEQAAARSPSQTQKSTDSKDVCRMFDTQEPGKDADQTPAKTKNLGEPEDYGRTSETQEKECETKDLPVQYGSRNGSETSDMRDERKERRGPEAHGTAGQKERDRKTRPLVLETQTQDGKYQELQGLSKSKDAEKGSETQYLSSEGGDQTHPELEGTAVSGEEAEHTKEGTAEAFVNSKNAPAAERTLGARERTQDLAPLEKQSVGENTRVTKTHDQPVEEEDGYQGEDPESPFTQSDEGSSETPNSLASEEGNSSSETGELPVQGDSQSQGDQHGESVQGGHNNNPDTQRQGTPGEKNRALEAVVPAVRGEDVQLTEDQEQPARGEHKNQGPGTKGPGAAVEPNGHPEAQESTAGDENRKSLEIEITGALDEDFTDQLSLMQLPGKGDSRNELKVQGPSSKEEKGRATEAQNTLLESLDEDNSASLKIQLETKEPVTSEEEDESPQELAGEGGDQKSPAKKEHNSSVPWSSLEKQMQRDQEPCSVERGAVYSSPLYQYLQEKILQQTNVTQEEHQKQVQIAQASGPELCSVSLTSEISDCSVFFNYSQASQPYTRGLPLDESPAGAQETPAPQALEDKQGHPQRERLVLQREASTTKQ

SEQ ID NO: 16563 - protein, 415 aa, Homo sapiens
EIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 16564 - protein, 533 aa, Homo sapiens
MEEKGSKRGLEAAGKAGLATAGPGLLPRKPPGLAAGPAGTYGKAVSPPPSPRASPVAALKAKVIQKLEDVSKPPAYAYPATPSSHPTSPPPASPPPTPGITRKEEAPENVVEKKDLELEKEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSPPQGLPPCMGQGSPMPAGLPDCARGPAPTLSGWPRLGEQSRVGLQPGVSVKGTRWRGPGTGPPWSKPSHYRKPQWC

SEQ ID NO: 16565 - protein, 2968 aa, Homo sapiens
MDGRDFGPQRSVHGPPPPLLSGLAMDSHRVGAATAGRLPASGLPGPLPPGKYMAGLNLHPHPGEAFLGSFVASGMGPSASSHGSPVPLPSDLSFRSPTPSNLPMVQLWAAHAHEGFSHLPSGLYPSYLHLNHLEPPSSGSPLLSQLGQPSIFDTQKGQGPGGDGFYLPTAGAPGSLHSHAPSARTPGGGHSSGAPAKGSSSRDGPAKERAGRGGEPPPLFGKKDPRARGEEASGPRGVVDLTQEARAEGRQDRGPPRLAERLSPFLAESKTKNAALQPSVLTMCNGGAGDVGLPALVAEAGRGGAKEAARQDEGARLLRRTETLLPGPRPCPSPLPPPPAPPKGPPAPPAATPAGVYTVFREQGREHRVVAPTFVPSVEAFDERPGPIQIASQARDARAREREAGRPGVLQAPPGSPRPLDRPEGLREKNSVIRSLKRPPPADAPTVRATRASPDPRAYVPAKELLKPEADPRPCERAPRGPAGPAAQQAAKLFGLEPGRPPPTGPEHKWKPFELGNFAATQMAVLAAQHHHSRAEEEAAVVAASSSKKAYLDPGAVLPRSAATCGRPVADMHSAAHGSGEASAMQSLIKYSGSFARDAVAVRPGGCGKKSPFGGLGTMKPEPAPTSAGASRAQARLPHSGGPAAGGGRQLKRDPERPESAKAFGREGSGAQGEAEVRHPPVGIAVAVARQKDSGGSGRLGPGLVDQERSLSLSNVKGHGRADEDCVDDRARHREERLLGARLDRDQEKLLRESKELADLARLHPTSCAPNGLNPNLMVTGGPALAGSGRWSADPAAHLATHPWLPRSGNASMWLAGHPYGLGPPSLHQGMAPAFPPGLGGSLPSAYQFVRDPQSGQLVVIPSDHLPHFAELMERATVPPLWPALYPPGRSPLHHAQQLQLFSQQHFLRQQEFLYLQQQAAQALELQRSAQLVQERLKAQEHRAEMEEKGSKRGLEAAGKAGLATAGPGLLPRKPPGLAAGPAGTYGKAVSPPPSPRASPVAALKAKVIQKLEDVSKPPAYAYPATPSSHPTSPPPASPPPTPGITRKEEAPENVVEKKDLELEKEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPHASSLTAAKRSKAKAKGKEVKKENRGKGGAVSKLMESMAAEEDFEPNQDSSFSEDEHLPRGGAVERPLTPAPRSCIIDKDELKDGLRVLIPMDDKLLYAGHVQTVHSPDIYRVVVEGERGNRPHIYCLEQLLQEAIIDVRPASTRFLPQGTRIAAYWSQQYRCLYPGTVVRGLLDLEDDGDLITVEFDDGDTGRIPLSHIRLLPPDYKIQCAEPSPALLVPSAKRRSRKTSKDTGEGKDGGTAGSEEPGAKARGRGRKPSAKAKGGRAATLEEGNPTDEVPSTPLALEPSSTPGSKKSPPEPVDKRAKAPKARPAPPQPSPAPPAFTSCPAPEPFAELPAPATSLAPAPLITMPATRPKPKKARAAEESGAKGPRRPGEEAELLVKLDHEGVTSPKSKKAKEALLLREDPGAGGWQEPKSLLSLGSYPPAAGSSEPKAPWPKATDGDLAQEPGPGLTFEDSGNPKSPDKAQAEQDGAEESESSSSSSSGSSSSSSSSSSSGSETEGEEEGDKNGDGGCGTGGRNCSAASSRAASPASSSSSSSSSSSSSSSSSSSSSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 16566 - protein, 1312 aa, Homo sapiens
MEEKGSKRGLEAAGKAGLATAGPGLLPRKPPGLAAGPAGTYGKAVSPPPSPRASPVAALKAKVIQKLEDVSKPPAYAYPATPSSHPTSPPPASPPPTPGITRKEEAPENVVEKKDLELEKEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPPPPPPPPPPHPPLPPPPLPPPPLPLRLPPLPPPPLPRPHPPPPPPLPPLLPPPQTRTLPAARTMRQPPPPRLALPRRRRSPPRPPSRPARRGPRPTPQARRRPRPSPRRLLRSPHSLCSPRLRPGPRADPRRERASTSPPPRSWPSGSACRPWRTGPRSPPSCQPGSSGSGSASPPSGVA

SEQ ID NO: 16567 - protein, 303 aa, Homo sapiens
MDGRDFGPQRSVHGPPPPLLSGLAMDSHRVGAATAGRLPASGLPGPLPPGKYMAGLNLHPHPGKCPAPCPSPPVFPGRSTRPGPPVHSRPGLGDSPSVGHGGAGRLGSQGWETPGPGAKAVESVARLGYLFRSVLGPREPKAGVVARATGAIPIPGAPAARAWAGVFKIWARKEQTGPAPRETPLPELESFSWQTLLLALVGPPGFCSQLHHSRRAGSLAVTERRGMREYAGGCGSTVTPALGPWPRGGRDAPFFPGRTAALGTCTPVGGRRPRPSGTPCFPARKRVRRCGRDTETGPSRSRT

SEQ ID NO: 16568 - protein, 2968 aa, Homo sapiens
MDGRDFGPQRSVHGPPPPLLSGLAMDSHRVGAATAGRLPASGLPGPLPPGKYMAGLNLHPHPGEAFLGSFVASGMGPSASSHGSPVPLPSDLSFRSPTPSNLPMVQLWAAHAHEGFSHLPSGLYPSYLHLNHLEPPSSGSPLLSQLGQPSIFDTQKGQGPGGDGFYLPTAGAPGSLHSHAPSARTPGGGHSSGAPAKGSSSRDGPAKERAGRGGEPPPLFGKKDPRARGEEASGPRGVVDLTQEARAEGRQDRGPPRLAERLSPFLAESKTKNAALQPSVLTMCNGGAGDVGLPALVAEAGRGGAKEAARQDEGARLLRRTETLLPGPRPCPSPLPPPPAPPKGPPAPPAATPAGVYTVFREQGREHRVVAPTFVPSVEAFDERPGPIQIASQARDARAREREAGRPGVLQAPPGSPRPLDRPEGLREKNSVIRSLKRPPPADAPTVRATRASPDPRAYVPAKELLKPEADPRPCERAPRGPAGPAAQQAAKLFGLEPGRPPPTGPEHKWKPFELGNFAATQMAVLAAQHHHSRAEEEAAVVAASSSKKAYLDPGAVLPRSAATCGRPVADMHSAAHGSGEASAMQSLIKYSGSFARDAVAVRPGGCGKKSPFGGLGTMKPEPAPTSAGASRAQARLPHSGGPAAGGGRQLKRDPERPESAKAFGREGSGAQGEAEVRHPPVGIAVAVARQKDSGGSGRLGPGLVDQERSLSLSNVKGHGRADEDCVDDRARHREERLLGARLDRDQEKLLRESKELADLARLHPTSCAPNGLNPNLMVTGGPALAGSGRWSADPAAHLATHPWLPRSGNASMWLAGHPYGLGPPSLHQGMAPAFPPGLGGSLPSAYQFVRDPQSGQLVVIPSDHLPHFAELMERATVPPLWPALYPPGRSPLHHAQQLQLFSQQHFLRQQEFLYLQQQAAQALELQRSAQLVQERLKAQEHRAEMEEKGSKRGLEAAGKAGLATAGPGLLPRKPPGLAAGPAGTYGKAVSPPPSPRASPVAALKAKVIQKLEDVSKPPAYAYPATPSSHPTSPPPASPPPTPGITRKEEAPENVVEKKDLELEKEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPHASSLTAAKRSKAKAKGKEVKKENRGKGGAVSKLMESMAAEEDFEPNQDSSFSEDEHLPRGGAVERPLTPAPRSCIIDKDELKDGLRVLIPMDDKLLYAGHVQTVHSPDIYRVVVEGERGNRPHIYCLEQLLQEAIIDVRPASTRFLPQGTRIAAYWSQQYRCLYPGTVVRGLLDLEDDGDLITVEFDDGDTGRIPLSHIRLLPPDYKIQCAEPSPALLVPSAKRRSRKTSKDTGEGKDGGTAGSEEPGAKARGRGRKPSAKAKGDRAATLEEGNPTDEVPSTPLALEPSSTPGSKKSPPEPVDKRAKAPKARPAPPQPSPAPPAFTSCPAPEPFAELPAPATSLAPAPLITMPATRPKPKKARAAEESGAKGPRRPGEEAELLVKLDHEGVTSPKSKKAKEALLLREDPGAGGWQEPKSLLSLGSYPPAAGSSEPKAPWPKATDGDLAQEPGPGLTFEDSGNPKSPDKAQAEQDGAEESESSSSSSSGSSSSSSSSSSSGSETEGEEEGDKNGDGGCGTGGRNCSAASSRAASPASSSSSSSSSSSSSSSSSSSSSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 16569 - protein, 167 aa, Homo sapiens
MIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 16570 - protein, 465 aa, Homo sapiens [sequence omitted]

SEQ ID NO: 16571 - protein, 115 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVSECRTTDGFGCA

SEQ ID NO: 16572 - protein, 465 aa, Homo sapiens [sequence omitted]

SEQ ID NO: 16573 - protein, 396 aa, Homo sapiens
MAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQVIREGLHGCEMKTFVSPEAISPDLVKKIRDFHRKILTLPEMMRMFSENLAHHLEIDSGVITLDPQTASRSLVLSEDRKSVRYTRQKKSLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 16574 - protein, 465 aa, Homo sapiens [sequence omitted]

SEQ ID NO: 16575 - protein, 465 aa, Homo sapiens [sequence omitted]

SEQ ID NO: 16576 - protein, 164 aa, Homo sapiens
  MOD_RES (1)..(1): Any amino acid
XKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSDRQPEPGSLGRQEVSEVHPAEEEPARQPPALRRP

SEQ ID NO: 16577 - protein, 164 aa, Homo sapiens; identical to SEQ ID NO: 16576
  MOD_RES (1)..(1): Any amino acid

SEQ ID NO: 16578 - protein, 164 aa, Homo sapiens; identical to SEQ ID NO: 16576
  MOD_RES (1)..(1): Any amino acid

SEQ ID NO: 16579 - protein, 164 aa, Homo sapiens; identical to SEQ ID NO: 16576
  MOD_RES (1)..(1): Any amino acid

SEQ ID NO: 16580 - protein, 465 aa, Homo sapiens [sequence omitted]

SEQ ID NO: 16581 - protein, 164 aa, Homo sapiens; identical to SEQ ID NO: 16576
  MOD_RES (1)..(1): Any amino acid

SEQ ID NO: 16582 - protein, 465 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSGVITLDPQTASRSLVLSEDRKSVRYTRQKKNLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 16583 - protein, 465 aa, Homo sapiens; identical to SEQ ID NO: 16582

SEQ ID NO: 16584 - protein, 465 aa, Homo sapiens [sequence omitted]

SEQ ID NO: 16585 - protein, 164 aa, Homo sapiens; identical to SEQ ID NO: 16576
  MOD_RES (1)..(1): Any amino acid

SEQ ID NO: 16586 - protein, 164 aa, Homo sapiens; identical to SEQ ID NO: 16576
  MOD_RES (1)..(1): Any amino acid

SEQ ID NO: 16587 - protein, 164 aa, Homo sapiens; identical to SEQ ID NO: 16576
  MOD_RES (1)..(1): Any amino acid

SEQ ID NO: 16588 - protein, 396 aa, Homo sapiens
MAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQVIREGLHGCEMKTFVSPEAISPDLVKKIRDFHRKILTLPEMMRMFSENLAHHLEIDSGVITLDPQTASRSLVLSEDRKSVRYTRQKKNLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 16589 - protein, 115 aa, Homo sapiens; identical to SEQ ID NO: 16571

SEQ ID NO: 16590 - protein, 115 aa, Homo sapiens; identical to SEQ ID NO: 16571

SEQ ID NO: 16591 - protein, 396 aa, Homo sapiens; identical to SEQ ID NO: 16573

SEQ ID NO: 16592 - protein, 396 aa, Homo sapiens; identical to SEQ ID NO: 16573

SEQ ID NO: 16593 - protein, 115 aa, Homo sapiens; identical to SEQ ID NO: 16571

SEQ ID NO: 16594 - protein, 115 aa, Homo sapiens; identical to SEQ ID NO: 16571

SEQ ID NO: 16595 - protein, 396 aa, Homo sapiens; identical to SEQ ID NO: 16573

SEQ ID NO: 16596 - protein, 396 aa, Homo sapiens; identical to SEQ ID NO: 16588

SEQ ID NO: 16597 - protein, 396 aa, Homo sapiens; identical to SEQ ID NO: 16573

SEQ ID NO: 16598 - protein, 115 aa, Homo sapiens; identical to SEQ ID NO: 16571

SEQ ID NO: 16599 - protein, 396 aa, Homo sapiens; identical to SEQ ID NO: 16573

SEQ ID NO: 16600 - protein, 115 aa, Homo sapiens; identical to SEQ ID NO: 16571

SEQ ID NO: 16601 - protein, 115 aa, Homo sapiens; identical to SEQ ID NO: 16571

SEQ ID NO: 16602 - protein, 477 aa, Homo sapiens
MEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 16603 - protein, 175 aa, Homo sapiens
MEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQ

SEQ ID NO: 16604 - protein, 477 aa, Homo sapiens; identical to SEQ ID NO: 16602

SEQ ID NO: 16605 - protein, 477 aa, Homo sapiens; identical to SEQ ID NO: 16602

SEQ ID NO: 16606 - protein, 343 aa, Homo sapiens
MEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLGKWAPRARTSDPGSLGDAPLYPLASEATNGGGSTSALPGDGHWLFTVPS

SEQ ID NO: 16607 - protein, 50 aa, Homo sapiens
MEAVELARKLQEEATCSICLDYFTDPVMTTCGHNFCRACIQLSWEKARGK

SEQ ID NO: 16608 - protein, 465 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQKAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRSWAVKLETSEAVSLELHTMCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGIFLDYEAGVVSFYNGNTGCHIFTFPKASFSDTLRPYFQVYQYSPLFLPPPGD

SEQ ID NO: 16609 - protein, 465 aa, Homo sapiens; identical to SEQ ID NO: 16608

SEQ ID NO: 16610 - protein, 465 aa, Homo sapiens; identical to SEQ ID NO: 16608

SEQ ID NO: 16611 - protein, 229 aa, Homo sapiens
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQQWLGQLEHMPAEAARILDISRAVTQLRSLVIDLERTAKELDTNTLKNAGDLLNRSAPQKLEVIYPQLEKGVSELLLQPPQKL

SEQ ID NO: 16612 - protein, 258 aa, Homo sapiens
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQFQVDHGNHRLEAGPESQHQTREQLGALPQQWLGQLEHMPAEAARILDISRAVTQLRSLVIDLERTAKELDTNTLKNAGDLLNRSAPQKLEVIYPQLEKGVSELLLQPPQKL

SEQ ID NO: 16613 - protein, 258 aa, Homo sapiens; identical to SEQ ID NO: 16612

SEQ ID NO: 16614 - protein, 258 aa, Homo sapiens; identical to SEQ ID NO: 16612

SEQ ID NO: 16615 - protein, 229 aa, Homo sapiens; identical to SEQ ID NO: 16611

SEQ ID NO: 16616 - protein, 229 aa, Homo sapiens
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQQWLGQLEHMPAEAARILDISRAVTQLRSLVIDLERMAKELDTNTLKNAGDLLNRSAPQKLEVIYPQLKKGVSELLLQPPQKL

SEQ ID NO: 16617 - protein, 229 aa, Homo sapiens; identical to SEQ ID NO: 16611

SEQ ID NO: 16618 - protein, 258 aa, Homo sapiens
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQFQVDHGNHRLEAGPESQHQTREQLGALPQQWLGQLEHMPAEAARILDISRAVTQLRSLVIDLERMAKELDTNTLKNAGDLLNRSAPQKLEVIYPQLKKGVSELLLQPPQKL

SEQ ID NO: 16619 - protein, 229 aa, Homo sapiens; identical to SEQ ID NO: 16611

SEQ ID NO: 16620 - protein, 258 aa, Homo sapiens; identical to SEQ ID NO: 16618

SEQ ID NO: 16621 - protein, 258 aa, Homo sapiens
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHCKERLNRRSRKLRKDIAELQRLKAQQEKKLQALQFQVDHGNHRLEAGPESQHQTREQLGALPQQWLGQLEHMPAEAARILDISRAVTQLRSLVIDLERTAKELDTNTLKNAGDLLNRSAPQKLEVIYPQLEKGVSELLLQPPQKL

SEQ ID NO: 16622 - protein, 258 aa, Homo sapiens; identical to SEQ ID NO: 16612

SEQ ID NO: 16623 - protein, 258 aa, Homo sapiens; identical to SEQ ID NO: 16612

SEQ ID NO: 16624 - protein, 229 aa, Homo sapiens; identical to SEQ ID NO: 16611

SEQ ID NO: 16625 - protein, 258 aa, Homo sapiens; identical to SEQ ID NO: 16612

SEQ ID NO: 16626 - protein, 229 aa, Homo sapiens
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHCKERLNRRSRKLRKDIAELQRLKAQQEKKLQALQQWLGQLEHMPAEAARILDISRAVTQLRSLVIDLERTAKELDTNTLKNAGDLLNRSAPQKLEVIYPQLEKGVSELLLQPPQKL

SEQ ID NO: 16627 - protein, 229 aa, Homo sapiens; identical to SEQ ID NO: 16616

SEQ ID NO: 16628 - protein, 258 aa, Homo sapiens; identical to SEQ ID NO: 16612

SEQ ID NO: 16629 - protein, 258 aa, Homo sapiens; identical to SEQ ID NO: 16621

SEQ ID NO: 16630 - protein, 258 aa, Homo sapiens; identical to SEQ ID NO: 16612

SEQ ID NO: 16631 - protein, 258 aa, Homo sapiens; identical to SEQ ID NO: 16612

SEQ ID NO: 16632 - protein, 723 aa, Homo sapiens
METAMCVCCPCCTWQRCCPQLCSCLCCKFIFTSERNCTCFPCPYKDERNCQFCHCTCSESPNCHWCCCSWANDPNCKCCCTASSNLNCYYYESRCCRNTIITFHKGRLRSIHTSSKTALRTGSSDTQVDEVKSIPANSHLVNHLNCPMCSRLRLHSFMLPCNHSLCEKCLRQLQKHAEVTENFFILICPVCDRSHCMPYSNKMQLPENYLHGRLTKRYMQEHGYLKWRFDRSSGPILCQVCRNKRIAYKRCITCRLNLCNDCLKAFHSDVAMQDHVFVDTSAEEQDEKICIHHPSSRIIEYCRNDNKLLCTFCKFSFHNGHDTISLIDACSERAASLFSAIAKFKAVRYEIDNDLMEFNILKNSFKADKEAKRKEIRNGFLKLRSILQEKEKIIMEQIENLEVSRQKEIEKYVYVTTMKVNEMDGLIAYSKEALKETGQVAFLQSAKILVDQIEDGIQTTYRPDPQLRLHSINYVPLDFVELSSAIHELFPTGPKKVRSSGDSLPSPYPVHSETMIARKVTFSTHSLGNQHIYQRSSSMLSFSNTDKKAKVGLEACGRAQSATPAKPTDGLYTYWSAGADSQSVQNSSSFHNWYSFNDGSVKTPGPIVIYQTLVYPRAAKVYWTCPAEDVDSFEMEFYEVITSPPNNVQMELCGQIRDIMQQNLELHNLTPNTEYVFKVRAINDNGPGQWSDICKVVTPDGHGKNRAKWGLLKNIQSALQKHF

SEQ ID NO: 16633 - protein, 446 aa, Homo sapiens
MDSDFSHAFQKELTCVICLNYLVDPVTICCGHSFCRPCLCLSWEEAQSPANCPACREPSPKMDFKTNILLKNLVTIARKASLWQFLSSEKQICGTHRQTKKMFCDMDKSLLCLLCSNSQEHGAHKHHPIEEAAEEHREKLLKQMRILWKKIQENQRNLYEEGRTAFLWRGNVVLRAQMIRNEYRKLHPVLHKEEKQHLERLNKEYQEIFQQLQRSWVKMDQKSKHLKEMYQELMEMCHKPDVELLQDLGDIVARSESVLLHMPQPVNPELTAGPITGLVYRLNRFRVEISFHFEVTNHNIRLFEDVRSWMFRRGPLNSDRSDYFAAWGARVFSFGKHYWELDVDNSCDWALGVCNNSWIRKNSTMVNSEDIFLLLCLKVDNHFNLLTTSPVFPHYIEKPLGRVGVFLDFESGSVSFLNVTKSSLIWSYPAGSLTFPVRPFFYTGHR

SEQ ID NO: 16634 - protein, 759 aa, Homo sapiens
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 16635 - protein, 736 aa, Homo sapiens
MKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 16636 - protein, 644 aa, Homo sapiens
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRSDPSGRDGVWGSWWE

SEQ ID NO: 16637 - protein, 551 aa, Homo sapiens
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPGIQNLARRGGACLQFQLLGRLR

SEQ ID NO: 16638 - protein, 498 aa, Homo sapiens
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRGCGHRGLCSGAPQCLRPPSLTPSAPLPMIRSSCAGGCPPIHHLPGTIPLSSGARMCLLSQAPPAGSGGRR

SEQ ID NO: 16639 - protein, 717 aa, Homo sapiens
MAAKRGTKTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 16640 - protein, 505 aa, Homo sapiens
MRRGGILGHRPGPQAFLVPGASAATLYKTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRGCGHRGLCSGAPQCLRPPSLTPSAPLPMIRSSCAGGCPPIHHLPGTIPLSSGARMCLLSQAPPAGSGGRR

SEQ ID NO: 16641 - protein, 633 aa, Homo sapiens
MFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 16642 - protein, 224 aa, Homo sapiens
MSRRIIVGTLQRTQRNMNSGISQVFQRELTCPICMNYFIDPVTIDCGHSFCRPCFYLNWQDIPILTQCFECIKTIQQRNLKTNIRLKKMASLARKASLWLFLSSEEQMCGIHRETKKMFCEVDRSLLCLLCSSSQEHRYHRHCPAEWAAEEHWEKLLKKMQSLWEKACENQRNLNVETTRISHWKAFGDILYRSESVLLHMPQPLNLALRAGPITGLRDRLNQF

SEQ ID NO: 16643 - protein, 452 aa, Homo sapiens
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHREKLLQKMQSLWEKACENHRNLNVETTRTRCWKDYVNLRLEAIRAEYQKMPAFHHEEEKHNLEMLKKKGKEIFHRLHLSKAKMAHRMEILRGMYEELNEMCHKPDVELLQAFGDILHRSESVLLHMPQPLNPELSAGPITGLRDRLNQFRVHITLHHEEANNDIFLYEILRSMCIGCDHQDVPYFTATPRSFLAWGVQTFTSGKYYWEVHVGDSWNWAFGVCNMYRKEKNQNEKIDGKAGLFLLGCVKNDIQCSLFTTSPLMLQYIPKPTSRVGLFLDCEAKTVSFVDVNQSSLIYTIPNCSFSPPLRPIFCCIHF

SEQ ID NO: 16644 - protein, 446 aa, Homo sapiens
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHREKLLQKMQSLWEKACENHRNLNVETTRTRCWKDYVNLRLEAIRAEYQKMPAFHHEEEKHNLEMLKKKGKEIFHRLHLSKAKMAHRMEILRGMYEELNEMCHKPDVELLQDLGDMVARSESVLLHMLQPVNPELPTGPITGPVDRLNHFRVEISFTWEGTNYNIGLFEDVRSLMFRRGSLNSDRSDYFAAWGAWVFSSGKHYWELDVDNSWDWALGVCKDSWIRKNSTMFNSKDIFLLLCVKVDNHFSLLTTSPMFPHYVEKPLVRVGVFLNFESGSVSFLNVTKNSLIWNYPAGSLNFPVRSFFYTGHR

SEQ ID NO: 16645 - protein, 452 aa, Homo sapiens
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHREKLLQKMQSLWEKACENHRNLNVETTRTRCWKDYVNLRLEAIRAEYQKMPAFHHEEEKHNLEMLKKKGKEIFHRLHLSKAKMAHRMEILRGMYEELNEMCHKPDVELLQAFGDILHRSESVLLHMPQPLNPELSAGPITGLRDRLNQFRVHITLHHEEANSDIFLYEILRSMCIGCDHQDVPYFTATPRSFLAWGVQTFTSGKYYWEVHVGDSWNWAFGVCNMYRKEKNQNEKIDGKEGLFLLGCIKNDIQCSLFTTSPLMLQYIPKPTSRVGLFLDCEAKTVSFVDVNQSSLIYTIPNCSFSPPLRPIFCCIHF

SEQ ID NO: 16646 - protein, 297 aa, Homo sapiens
MAGYATTPSPMQTLQEEAVCAICLDYFKDPVSISCGHNFCRGCVTQLWSKEDEEDQNEEEDEWEEEEDEEAVGAMDGWDGSIREVLYRGNADEELFQDQDDDELWLGDSGITNWDNVDYMWDEEEEEEEEDQDYYLGGLRPDLRIDVYREEEILEAYDEDEDEELYPDIHPPPSLPLPGQFTCPQCRKSFTRRSFRPNLQLANMVQIIRQMCPTPYRGNRSNDQGMCFKHQEALKLFCEVDKEAICVVCRESRSHKQHSVLPLEEVVQEYQEIKLETTLVGILQIEQESIHSKAYNQ

SEQ ID NO: 16647 - protein, 486 aa, Homo sapiens
MAWAPPGERLREDARCPVCLDFLQEPVSVDCGHSFCLRCISEFCEKSDGAQGGVYACPQCRGPFRPSGFRPNRQLAGLVESVRRLGLGAGPGARRCARHGEDLSRFCEEDEAALCWVCDAGPEHRTHRTAPLQEAAGSYQVKLQMALELMRKELEDALTQEANVGKKTVIWKEKVEMQRQRFRLEFEKHRGFLAQEEQRQLRRLEAEERATLQRLRESKSRLVQQSKALKELADELQERCQRPALGLLEGVRGVLSRSKAVTRLEAENIPMELKTACCIPGRRELLRKFQVDVKLDPATAHPSLLLTADLRSVQDGEPWRDVPNNPERFDTWPCILGLQSFSSGRHYWEVLVGEGAEWGLGVCQDTLPRKGETTPSPENGVWALWLLKGNEYMVLASPSVPLLQLESPRCIGIFLDYEAGEISFYNVTDGSYIYTFNQLFSGLLRPYFFICDATPLILPPTTIAGSGNWASRDHLDPASDVRDDHL

SEQ ID NO: 16648 - protein, 471 aa, Homo sapiens
MEFVTALVNLQEESSCPICLEYLKDPVTINCGHNFCRSCLSVSWKDLDDTFPCPVCRFCFPYKSFRRNPQLRNLTEIAKQLQIRRSKRKRQKENAMCEKHNQFLTLFCVKDLEILCTQCSFSTKHQKHYICPIKKAASYHREILEGSLEPLRNNIERVEKVIILQGSKSVELKKKVEYKREEINSEFEQIRLFLQNEQEMILRQIQDEEMNILAKLNENLVELSDYVSTLKHLLREVEGKSVQSNLELLTQAKSMHHKYQNLKCPELFSFRLTKYGFSLPPQYSGLDRIIKPFQVDVILDLNTAHPQLLVSEDRKAVRYERKKRNICYDPRRFYVCPAVLGSQRFSSGRHYWEVEVGNKPKWILGVCQDCLLRNWQDQPSVLGGFWAIGRYMKSGYVASGPKTTQLLPVVKPSKIGIFLDYELGDLSFYNMNDRSILYTFNDCFTEAVWPYFYTGTDSEPLKICSVSDSER

SEQ ID NO: 16649 - protein, 90 aa, Homo sapiens
MEFVTALVNLQEESSCPICLEYLKDPVTINCGHNFCRSCLSVSWKDLDDTFPCPVCRFCFPYKSFRRNPQLRNLTEIAKQLQIRRSKRKR

SEQ ID NO: 16650 - protein, 471 aa, Homo sapiens; identical to SEQ ID NO: 16648

SEQ ID NO: 16651 - protein, 471 aa, Homo sapiens; identical to SEQ ID NO: 16648

SEQ ID NO: 16652 - protein, 209 aa, Homo sapiens
MEFVTALADLRAEASCPICLDYLKDPVTISCGHNFCLSCIIMSWKDLHDSFPCPFCHFCCPERKFISNPQLGSLTEIAKQLQIRSKKRKRQEEKHVCKKHNQVLTFFCQKDLELLCPRCSLSTDHQHHCVWPIKKAASYHRKKLEEYNAPWKERVELIEKVITMQTRKSLELKKKMESPSVTRLECSCTISAHFNLRLPGSSDSSASGS

SEQ ID NO: 16653 - protein, 475 aa, Homo sapiens
MACSLKDELLCSICLSIYQDPVSLGCEHYFCRRCITEHWVRQEAQGARDCPECRRTFAEPALAPSLKLANIVERYSSFPLDAILNARRAARPCQAHDKVKLFCLTDRALLCFFCDEPALHEQHQVTGIDDAFDELQRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQPSRGFYCIVMHDGNQYSACTEPWTRLNVRDKLDKVGVFLDYDQGLLIFYNADDMSWLYTFREKFPGKLCSYFSPGQSHANGKNVQPLRINTVRI

SEQ ID NO: 16654 - protein, 394 aa, Homo sapiens
MACSLKDELLCSICLSIYQDPVSLGCEHYFCRRCITEHWVRQEAQGARDCPECRRTFAEPALAPSLKLANIVERYSSFPLDAILNARRAARPCQAHDKVKLFCLTDRALLCFFCDEPALHEQHQVTGIDDAFDELQRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQNLGCKGVWEMSFP

SEQ ID NO: 16655 - protein, 394 aa, Homo sapiens; identical to SEQ ID NO: 16654

SEQ ID NO: 16656 - protein, 475 aa, Homo sapiens; identical to SEQ ID NO: 16653

SEQ ID NO: 16657 - protein, 354 aa, Homo sapiens
MPEKTAVDQPWTQALRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQPSRGFYCIVMHDGNQYSACTEPWTRLNVRDKLDKVGVFLDYDQGLLIFYNADDMSWLYTFREKFPGKLCSYFSPGQSHANGKNVQPLRINTVRI

SEQ ID NO: 16658 - protein, 449 aa, Homo sapiens
MDSDDLQVFQNELICCICVNYFIDPVTIDCGHSFCRPCLCLCSEEGRAPMRCPSCRKTSEKPNFNTNLVLKKLSSLARQTRPQNINSSDNICVLHEETKELFCEADKRLLCGPCSESPEHMAHSHSPIGWAAEECREKLIKEMDYLWEINQETRNNLNQETSTFHSLKDYVSVRKRIITIQYQKMPIFLDEEEQRHLQALEREAEELFQQLQDSQVRMTQHLERMKDMYRELWETCHMPDVVLLQDVRNVSARTDLAQMQKPQPVNPELTSWCITGVLDMLNNFRVDSALSTEMIPCYISLSEDVRYVIFGDDHLSAPTDPQGVDSFAVWGAQAFTSGKHYWEVDVTLSSNWILGVCRDSRTADANFVIDSDERFFLISSKRSNHYSLSTNSPPLIQYVQRPLGRVGVFLDYDNGSVSFFDVSKGSLIYGFPPSSFSSPLRPFFCFGCT

SEQ ID NO: 16659 - protein, 447 aa, Homo sapiens
MDSDTLRVFQNELICCICVNYFIDPVTTDCVHSFCRPCLCLCSEEGRAPMRCPLCRKISEKPNFNTNVALKKLASLARQTRPQNINSSDNICVLHEETKELFCEADKRLLCGPCSESPEHMAHSHSPIGWAAEECRVQKLIKEMDYLWKINQETQNNLNQETSKFCSLVEDKRNRIVYRYQKMHIFLDEEEQRHLQALEREAKELFQQLQDSQVRMTQHLEGMKDMYRELWETYHMPDVELLQDVGNISARTDLAQMPKPQPVNPELTSWCITGVLDMLNNFRVDNALSTEMTPCYISLSEDVRRVIFGDDHRSAPMDPQGVESFAVWCAQAFTSGKHYWEVDVTHSSNWILGVCRDSRTADTNIVIDSDKTFFSISSKTSNHYSLSTNSPPLIQYVQRPLGWVGVFLDYDNGSVSFFDVSKGSLIYGFPPSSFSSPLRPFFCFGCT

SEQ ID NO: 16660 - protein, 517 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVEAPGPLAPVPSTVCPLRRKLWQNYRNLTFDPVSANRHFYLSRQDQQVKHCRQSRGPGGPGSFELWQVQCAQSFQAGHHYWEVRASDHSVTLGVSYPQLPRCRLGPHTDNIGRGPCSWGLCVQEDSLQAWHNGEAQRLPGVSGRLLGMDLDLASGCLTFYSLEPQTQPLYTFHALFNQPLTPVFWLLEGRTLTLCHQPGAVFPLGPQEEVLS

SEQ ID NO: 16661 - protein, 468 aa, Homo sapiens
MSTADLMENLREELTCFICLDYFSSPVTTECGHSFCLVCLLRSWEEHNTPLSCPECWRTLEGPHFQSNERLGRLASIARQLRSQVLQSEDEQGSYGRMPTTAKALSDDEQGGSAFVAQSHGANRVHLSSEAEEHHREKLQEILNLLRVRRKEAQAVLTHEKERVKLCQEETKTCKQVVVSEYMKMHQFLKEEEQLQLQLLEQEEKENMRKLRNNEIKLTQQIRSLSKMIAQIESSSQSSAFESLEEVRGALERSEPLLLQCPEATTTELSLCRITGMKEMLRKFSTEITLDPATANAYLVLSEDLKSVKYGGSRQQLPDNPERFDQSATVLGTQIFTSGRHYWEVEVGNKTEWEVGICKDSVSRKGNLPKPPGDLFSLIGLKIGDDYSLWVSSPLKGQHVREPVCKVGVFLDYESGHIAFYNGTDESLIYSFPQASFQEALRPIFSPCLPNEGTNTDPLTICSLNSHV

SEQ ID NO: 16662 - protein, 387 aa, Homo sapiens
MVCGIQEAAENYRKLFQEILNTSREKLEAAKSILTDEQERMAMIQEEEQNFKKMIESEYSMRLRLLNEECEQNLQRQQECISDLNLRETLLNQAIKLATELEEMFQEMLQRLGRVGRENMEKLKESEARASEQVRSLLKLIVELEKKCGEGTLALLKNAKYSLERSKSLLLEHLEPAHITDLSLCHIRGLSSMFRVLQRHLTLDPETAHPCLALSEDLRTMRLRHGQQDGAGNPERLDFSAMVLAAESFTSGRHYWEVDVEKATRWQVGIYHGSADAKGSTARASGEKVLLTGSVMGTEWTLWVFPPLKRLFLEKKLDTVGVFLDCEHGQISFYNVTEMSLIYNFSHCAFQGALRPVFSLCIPNGDTSPDSLTILQHGPSCDATVSP

SEQ ID NO: 16663 - protein, 221 aa, Homo sapiens
MSKRLSPQLQHNITEDAYCETHLEPTRLFCDVDQITLCSKCFQSQEHKHHMVCGIQEAAENYRKLFQEILNTSREKLEAAKSILTDEQERMAMIQEEEQNFKKMIESEYSMRLRLLNEECEQNLQRQQECISDLNLRETLLNQAIKLATELEEMFQEMLQRLGRVGRENMEKLKESEARASEQVRSLLKLIVELEKKCGEGTLALLKVRCWEKENKIHSSI

SEQ ID NO: 16664 - protein, 390 aa, Homo sapiens
MCICHLPCRPVKPNIIGEQITSKMGAHYHCIICSATITRRTDMLGHVRRHMNKGETKSSYIAASTAKPPKEILKEADTDVQVCPNYSIPQKTDSYFNPKMKLNRQLIFCTLAALAEERKPLECLDAFGATGIMGLQWAKHLGNAVKVTINDLNENSVTLIQENCHLNKLKVVVDSKEKEKSDDILEEGEKNLGNIKVTKMDANVLMHLRSFDFIHLDPFGTSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEDYSANFVISYTGFPFVNRQDIRKTHIDSCLVTVMEACLERQQ

SEQ ID NO: 16665 - protein, 733 aa, Homo sapiens
MENMAEEELLPLEKEEVEVAQVQVPTPARDSAGVPAPAPDSALDSAPTPASAPAPAPALAQAPALSPSLASAPEEAKSKRHISIQRQLADLENLAFVTDGNFDSASSLNSDNLDAGNRQACPLCPKEKFRACNSHKLRRHLQNLHWKVSVEFEGYRMCICHLPCRPVKPNIIGEQITSKMGAHYHCIICSATITRRTDMLGHVRRHMNKGETKSSYIAASTAKPPKEILKEADTDVQVCPNYSIPQKTDSYFNPKMKLNRQLIFCTLAALAEERKPLECLDAFGATGIMGLQWAKHLGNAVKVTINDLNENSVTLIQENCHLNKLKVVVDSKEKEKSDDILEEGEKNLGNIKVTKMDANVLMHLRSFDFIHLDPFGTSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEENPYRQLPCNCHGSMPGKTAIELGPLWSSSLFNTGFLKRMLFESLHHGLDDIQTLIKTLIFESECTPQSQFSIHASSNVNKQEENGVFIKTTDDTTTDNYIAQGKRKSNEMITNLGKKQKTDVSTEHPPFYYNIHRHSIKGMNMPKLKKFLCYLSQAGFRVSRTHFDPMGVRTDAPLMQFKSILLKYSTPTYTGGQSESHVQSASEDTVTERVEMSVNDKAEASGCRRW

SEQ ID NO: 16666 - protein, 212 aa, Homo sapiens
TSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEENPYRQLPCNCHGSMPGKTAIELGPLWSSSLFNTGFLKRMLFESLHHGLDDIQTLIKTLIFESECTPQSQFSIHASSNVNKQGD

SEQ ID NO: 16667 - protein, 463 aa, Homo sapiens
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDMFLDLLNFAAETLVLGGRLVYWLPVYTPEYTEEMVPWHPCLELVSNCEQKLSSHTSRRLITMEKVKKFENRDQYSHLLSDHFLPYQGHNSFREKYFSGVTKRIAKEEKSTQE

SEQ ID NO: 16668 - protein, 458 aa, Homo sapiens
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDMFLDLLNFAAETLVLGGRLVYWLPVYTPEYTEEMVPWHPCLELVSNCEQKLSSHTSRRLITMEKNRDQYSHLLSDHFLPYQGHNSFREKYFSGVTKRIAKEEKSTQE

SEQ ID NO: 16669 - protein, 93 aa, Homo sapiens
MKRTVCAKSIFELWGHGQSPEELYSSLKNYPVEKMVPFLHSDSTYKIKIHTFNKTLTQEEKIKRIDALEFLPFEGKVNLKKPQHVFSVLEDYG

SEQ ID NO: 16670 - protein, 134 aa, Homo sapiens
MKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNT

SEQ ID NO: 16671 - protein, 257 aa, Homo sapiens
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLACST

SEQ ID NO: 16672 - protein, 170 aa, Homo sapiens
  MOD_RES (1)..(1): Any amino acid
XLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKCPESHVPVSLSYHLSDMFLDLLNFAAETLVLGGRLVYWL

SEQ ID NO: 16673 - protein, 125 aa, Homo sapiens
MKLLTHNLLSSHVRGVGSRGFPLRLQATEVRICPVEFNPNFVARMIPKVEWSAFLEAADNLRLIQVPKGPVEGYEENEEFLRTMHHLLLEVEVIEGTLQCPESGRMFPISRGIPNMLLSEEETES

SEQ ID NO: 16674 - protein, 448 aa, Homo sapiens
MRENVVVSNMERESGKPVAVVAVVTEPWFTQRYREYLQRQKLFDTQHRVEKMPDGSVALPVLGETLPEQHLQELRNRVAPGSPCMLTQLPDPVPSKRAQGCSPAQKLCLEVSRWVEGRGVKWSAELEADLPRSWQRHGNLLLLSEDCFQAKQWKNLGPELWETVALALGVQRLAKRGRVSPDGTRTPAVTLLLGDHGWVEHVDNGIRYKFDVTQCMFSFGNITEKLRVASLSCAGEVLVDLYAGIGYFTLPFLVHAGAAFVHACEWNPHAVVALRNNLEINGVADRCQIHFGDNRKLKLSNIADRVILGLIPSSEEGWPIACQVLRQDAGGILHIHQNVESFPGKNLQALGVSKVEKEHWLYPQQITTNQWKNGATRDSRGKMLSPATKPEWQRWAESAETRIATLLQQVHGKPWKTQILHIQPVKSYAPHVDHIVLDLECCPCPSVG

SEQ ID NO: 16675 - protein, 477 aa, Homo sapiens [sequence omitted]

SEQ ID NO: 16676 - protein, 310 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPGDPLRFHAHYIAQCWAPEDTIPLQDLVAAGRLGTSVRKTLLLCSPQPDGKVVYTSLQWASLQ

SEQ ID NO: 16677 - protein, 310 aa, Homo sapiens; identical to SEQ ID NO: 16676

SEQ ID NO: 16678 - protein, 310 aa, Homo sapiens; identical to SEQ ID NO: 16676

SEQ ID NO: 16679 - protein, 310 aa, Homo sapiens; identical to SEQ ID NO: 16676

SEQ ID NO: 16680 - protein, 310 aa, Homo sapiens; identical to SEQ ID NO: 16676

SEQ ID NO: 16681 - protein, 310 aa, Homo sapiens; identical to SEQ ID NO: 16676

SEQ ID NO: 16682 - protein, 310 aa, Homo sapiens; identical to SEQ ID NO: 16676

SEQ ID NO: 16683 - protein, 310 aa, Homo sapiens; identical to SEQ ID NO: 16676

SEQ ID NO: 16684 - protein, 310 aa, Homo sapiens; identical to SEQ ID NO: 16676

SEQ ID NO: 16685 - protein, 310 aa, Homo sapiens; identical to SEQ ID NO: 16676

SEQ ID NO: 16686 - protein, 310 aa, Homo sapiens; identical to SEQ ID NO: 16676

SEQ ID NO: 16687 - protein, 310 aa, Homo sapiens; identical to SEQ ID NO: 16676

SEQ ID NO: 16688 - protein, 732 aa, Homo sapiens
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQGYQLIGSHSGVKLCRWTKSMLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 16689 - protein, 338 aa, Homo sapiens
MDPSADTWDLFSPLISLWINRFYIYLGFAVSISLWICVQIVIKTQGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQVHAPRERRLLQTHILWN

SEQ ID NO: 16690 - protein, 176 aa, Homo sapiens
MDPSADTWDLFSPLISLWINRFYIYLGFAVSISLWICVQIVIKTQGFATVLAEAVTSLDLPVAIINLKEYDPDDHLIEEEEEPFESSSEEEFGGEDHQSLNSIVDVEDLGKIMDHVKKEKREKEQQEEKSGLFRNMGRNEDGERRAMITPALREALTKQVHAPRERRLLQTHILWN

SEQ ID NO: 16691 - protein, 259 aa, Homo sapiens
MDRSAEFRKWKAQCLSKADLSRKGSVDEDVVELVQFLNMRDQFFTTSSCAGRILLLDRGINGFEVQKQNCCWLLVTHKLCVKDDVIVALKKANGDATLKFEPFVLHVQCRQLQDAQILHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 16692 - protein, 175 aa, Homo sapiens
MDRSAEFRKWKAQCLSKADLSRKGSVDEDVVELVQFLNMRDQFFTTSSCAGRILLLDRAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 16693 - protein, 226 aa, Homo sapiens
MDRSAEFRKWKAQCLSKADLSRKGSVDEDVVELVQFLNMRDQFFTTSSCAGRILLLDRGINGFEVQKQNCCWLLVTHKLCVKDDVHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 16694 - protein, 315 aa, Homo sapiens
MAGQHLPVPRLEGVSREQFMQHLYPQRKPLVLEGIDLGPCTSKWTVDYLSQVGGKKEVKIHVAAVAQMDFISKNFVYRTLPFDQLVQRAAEEKHKEFFVSEDEKYYLRSLGEDPRKDVADIRKQFPLLKGDIKFPEFFKEEQFFSSVFRISSPGLQLWTHYDVMDNLLIQVTGKKRVVLFSPRDAQYLYLKGTKSEVLNIDNPDLAKYPLFSKARRYECSLEAGDVLFIPALWFHNVISEEFGVGVNIFWKHLPSECYDKTDTYGNKDPTAASRAAQILDRALKTLAELPEEYRDFYARRMVLHIQDKAYSKNSE

SEQ ID NO: 16695 - protein, 274 aa, Homo sapiens
MLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 16696 - protein, 756 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 16697 - protein, 780 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRNPSTAFYQAFHLNTLKESKSLWDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 16698 - protein, 229 aa, Homo sapiens
MPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 16699 - protein, 191 aa, Homo sapiens
MAGAAEDARALFRAGVCAALEAWPALQIAVENGFGGVHSQEKAKWLGGAVEDYFMRNADLELDEVEDFLGELLTNEFDTVVEDGSLPQVSQQLQTMFHHFQRGDGAALREMASCITQRKCKVTATALKTARETDEDEDDVDSVEEMEVTATNDGAATDGVCPQPEPSDPDAQTIKEEDIVEDGWTIVRRKK

SEQ ID NO: 16700 - protein, 644 aa, Homo sapiens
MEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 16701 - protein, 211 aa, Homo sapiens
MEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYRHVCRRPHAEVGQRPRWKAGDAAADPGGELQPRL

SEQ ID NO: 16702 - protein, 459 aa, Homo sapiens
MEPSTCRTMESEEDYVEEKESEKCVKEGVTNPSNSSQQALLKADYKALKNGVPSPIMATKIPKKVIAPVDTGDLEAGRRKRRRKRRSLAINLTNCKYESVRRAAQMCGLKEVGEDEEWTLYWTDCAVSLERVMDMKRFQKINHFPGMTEICRKDLLARNLNRMYKLYPSEYNIFPRTWCLPADYGDFQSYGRQRKARTYICKPDSGCQGRGIFITRNPREIKPGEHMICQQYISKPLLIDGFKFDMRVYVLITSCDPLRIFTYEEGLARFATTPYMEPSHNNLDNVCMHLTNYAINKHNENFVRDGAVGSKRKLSTLNIWLQEHSYNPGELWGDIEDIIIKTIISAHSVLRHNYRTCFPQYLNGGTCACFEILGFDILLDHKLKPWLLEVNHSPSFTTDSCLDQEVKDALLCDAMTLVNLRGCDKRKVMEEDKRRVKERLFQCYRQPRESRCARCLACV

SEQ ID NO: 16703 - protein, 815 aa, Homo sapiens
MEPSTCRTMESEEDYVEEKESEKCVKEGVTNPSNSSQQALLKADYKALKNGVPSPIMATKIPKKVIAPVDTGDLEAGRRKRRRKRRSLAINLTNCKYESVRRAAQMCGLKEVGEDEEWTLYWTDCAVSLERVMDMKRFQKINHFPGMTEICRKDLLARNLNRMYKLYPSEYNIFPRTWCLPADYGDFQSYGRQRKARTYICKPDSGCQGRGIFITRNPREIKPGEHMICQQYISKPLLIDGFKFDMRVYVLITSCDPLRIFTYEEGLARFATTPYMEPSHNNLDNVCMHLTNYAINKHNENFVRDGAVGSKRKLSTLNIWLQEHSYNPGELWGDIEDIIIKTIISAHSVLRHNYRTCFPQYLNGGTCACFEILGFDILLDHKLKPWLLEVNHSPSFTTDSCLDQEVKDALLCDAMTLVNLRGCDKRKVMEEDKRRVKERLFQCYRQPRESRKEKTESSHVAMLDQERYEDSHLGKYRRIYPGPDTEKYARFFKHNGSLFQETAASKAREECARQQLEEIRLKQEQQETSGTKRQKARDQNQGESAGEKSRPRAGLQSLSTHLAYRNRNWEKELLPGQLDTMRPQEIVEEEELERMKALLQRETLIRSLGIVEQLTRLQHPGPQGQKKLHESRDRLGSQELKSMSLVLLVLLRGAATEQGAPHFLHPVLPHESIPRILGALPSMNAAIPHVPRYHLQPKNFNWTGEPAAINSCSLSMKKAGRCYFSSARIRLTSQGQASRRLEAINRVLAGSVPPTLTPKQGYFLQPERVASDSWTECTLPSMVNSEHRAAKVPLCPASAPMLQRSRALLNINQFR

SEQ ID NO: 16704 - protein, 592 aa, Homo sapiens
MRGRDLCSSTQSQALGSLRTTTPAFTLNIPSEANHTEQPPAGLGARLQEAGVSIPPRRGRPTPTLEKKKKPHLMAEDEPSGALLKPLVFRVDETTPAVVQSVLLERGWNKFDKQEQNAEDWNLYWRTSSFRMTEHNSVKPWQQLNHHPGTTKLTRKDCLAKHLKHMRRMYGTSLYQFIPLTFVMPNDYTKFVAEYFQERQMLGTKHSYWICKPAELSRGRGILIFSDFKDFIFDDMYIVQKYISNPLLIGRYKCDLRIYVCVTGFKPLTIYVYQEGLVRFATEKFDLSNLQNNYAHLTNSSINKSGASYEKIKEVIGHGCKWTLSRFFSYLRSWDVDDLLLWKKIHRMVILTILAIAPSVPFAANCFELFGFDILIDDNLKPWLLEVNYSPALTLDCSTDVLVKRKLVHDIIDLIYLNGLRNEGREASNATHGNSNIDAAKSDRGGLDAPDCLPYDSLSFTSRMYNEDDSVVEKAVSVRPEAAPASQLEGEMSGQDFHLSTREMPQSKPKLRSRHTPHKTLMPYASLFQSHSCKTKTSPCVLSDRGKAPDPQAGNFVLVFPFNEATLGASRNGLNVKRIIQELQKLMNKQHS

SEQ ID NO: 16705 - protein, 519 aa, Homo sapiens
MAEDEPSGALLKPLVFRVDETTPAVVQSVLLERGWNKFDKQEQNAEDWNLYWRTSSFRMTEHNSVKPWQQLNHHPGTTKLTRKDCLAKHLKHMRRMYGTSLYQFIPLTFVMPNDYTKFVAEYFQERQMLGTKHSYWICKPAELSRGRGILIFSDFKDFIFDDMYIVQKYISNPLLIGRYKCDLRIYVCVTGFKPLTIYVYQEGLVRFATEKFDLSNLQNNYAHLTNSSINKSGASYEKIKEVIGHGCKWTLSRFFSYLRSWDVDDLLLWKKIHRMVILTILAIAPSVPFAANCFELFGFDILIDDNLKPWLLEVNYSPALTLDCSTDVLVKRKLVHDIIDLIYLNGLRNEGREASNATHGNSNIDAAKSDRGGLDAPDCLPYDSLSFTSRMYNEDDSVVEKAVSVRPEAAPASQLEGEMSGQDFHLSTREMPQSKPKLRSRHTPHKTLMPYASLFQSHSCKTKTSPCVLSDRGKAPDPQAGNFVLVFPFNEATLGASRNGLNVKRIIQELQKLMNKQHS

SEQ ID NO: 16706 - protein, 670 aa, Homo sapiens
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVVAIIRQ

SEQ ID NO: 16707 - protein, 569 aa, Homo sapiens
LGQRQLFQALRVEHRSPEPWLPRAVGGRRRAPDHQCRLPSRGGRPRGSCEAREHLGDRLQRGREDPGWAFLTRELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGYL

SEQ ID NO: 16708 - protein, 366 aa, Homo sapiens
MSWNISHPQLSDKLFGKNGVLEEQKSPGFKKRETEVYVGNLPLDISKEEILYLLKDFNPLDVHKIQNGCKCFAFVDLGSMQKVTLAIQELNGKLFHKRKLFVNTSKRPPKRTPDMIQQPRAPLVLEKASGEGFGKTAAIIQLAPKAPVDLCETEKLRAAFFAVPLEMRGSFLVLLLRECFRDLSWLALIHSVRGEAGLLVTSIVPKTPFFWAMHVTEALHQNMQALFSTLAQAEEQQPYLEGSTVMRGTRCLAEYHLGDYGHAWNRCWVLDRVDTWAVVMFIDFGQLATIPVQSLRSLDSDDFWTIPPLTQPFMLEKDILSSYEVVHRILKGKITGALNSAVTAPASNLAVVPPLLPLGCLQQAAA

SEQ ID NO: 16709 - protein, 351 aa, Homo sapiens
MSWNISHPQLSDKLFGKNGVLEEQKSPGFKKRETEVYVGNLPLDISKEEILYLLKDFNPLDVHKIQNGCKCFAFVDLGSMQKVTLAIQELNGKLFHKRKLFVNTSKRPPKRTPDMIQQPRAPLVLEKASGEGFGKTAAIIQLAPKAPVDLCETEKLRAAFFAVPLEMRGSFLVLLLRECFRDLSWLALIHSVRGEAGLLVTSIVPKTPFFWAMHVTEALHQNMQALFSTLAQAEEQQPYLEGSTVMRGTRCLAEYHLGDYGHAWNRCWVLDRVDTWAVVMFIDFGQLATIPVQSLRSLDSDDFWTIPPLTQPFMLEKDILSSYEVVHRILKGKITGALNSALHILKFEESK

SEQ ID NO: 16710 - protein, 395 aa, Homo sapiens
MLQLLVLKIEDPGCFWVIIKGCSPFLDHDVDYQKLNSAMNDFYNSTCQDIEIKPLTLEEGQVCVVYCEELKCWCRAIVKSITSSADQYLAECFLVDFAKNIPVKSKNIRVVVESFMQLPYRAKKFSLYCTKPVTLHIDFCRDSTDIVPAKKWDNAAIQYFQNLLKATTQVEARLCAVEEDTFEVYLYVTIKDEKVCVNDDLVAKNYACYMSPTKNKNLDYLEKPRLNIKSAPSFNKLNPALTLWPMFLQGKDVQGMEDSHGVNFPAQSLQHTWCKGIVGDLRPTATAQDKAVKCNMDSLRDSPKDKSEKKHHCISLKDTNKRVESSVYWPAKRGITIYADPDVPEASALSQKSNEKPLRLTEKKEYDEKNSCVKLLQFLNPDPLRADGISDLQQT

SEQ ID NO: 16711 - protein, 1177 aa, Homo sapiens
MLQLLVLKIEDPGCFWVIIKGCSPFLDHDVDYQKLNSAMNDFYNSTCQDIEIKPLTLEEGQVCVVYCEELKCWCRAIVKSITSSADQYLAECFLVDFAKNIPVKSKNIRVVVESFMQLPYRAKKFSLYCTKPVTLHIDFCRDSTDIVPAKKWDNAAIQYFQNLLKATTQVEARLCAVEEDTFEVYLYVTIKDEKVCVNDDLVAKNYACYMSPTKNKNLDYLEKPRLNIKSAPSFNKLNPALTLWPMFLQGKDVQGMEDSHGVNFPAQSLQHTWCKGIVGDLRPTATAQDKAVKCNMDSLRDSPKDKSEKKHHCISLKDTNKRVESSVYWPAKRGITIYADPDVPEASALSQKSNEKPLRLTEKKEYDEKNSCVKLLQFLNPDPLRADGISDLQQLQKLKGLQPPVVVLRNKIKPCLTIDSSPLSADLKKALQRNKFPGPSHTESYSWPPIARGCDVVVISHCESNPLLYLLPVLTVLQTGACYKSLPSRNGPLAVIVCPGWKKAQFIFELLGEYSMSSRPLHPVLLTIGLHKEEAKNTKLPRGCDVIVTTPYSLLRLLACQSLLFLRLCHLILDEVEVLFLEANEQMFAILDNFKKNIEVEERESAPHQIVAVGVHWNKHIEHLIKEFMNDPYIVITAMEEAALYGNVQQVVHLCLECEKTSSLLQALDFIPSQAQKTLIFTCSVAETEIVCKVVESSSIFCLKMHKEMIFNLQNVLEQWKKKLSSGSQIILALTDDCVPLLAITDATCVIHFSFPASPKVFGGRLYCMSDHFHAEQGSPAEQGDKKAKSVLLLTEKDASHAVGVLRYLERADAKVPAELYEFTAGVLEAKEDKKAGRPLCPYLKAFGFCKDKRICPDRHRINPETDLPRKLSSQALPSFGYIKIIPFYILNATNYFGRIVDKHMDLYATLNAEMNEYFKDSNKTTVEKVEKFGLYGLAEKTLFHRVQVLEVNQKEDAWALDDILVEFIDEGRTGLVTRDQLLHLPEHFHTLPPQAVEFIVCRVKPADNEIEWNPKVTRYIHHKIVGKLHDAKVILALGNTVWIDPMVHITNLSSLKTSVIDYNVRAEILSMGMGIDNPEHIEQLKKLREDAKIPACEESLSQTPPRVTGTSPAQDQDHPSEEQGGQGTPPAEDAACLQSPQPEDTGAEGGAESKTSSENQKPGGYLVFKRWLSSNR

SEQ ID NO: 16712 - protein, 186 aa, Homo sapiens
MDTFSTKSLALQAQKKLLSKMASKAVVAVLVDDTSSEVLDELYRATREFTRSRKEAQKMLKNLVKVALKLGLLLRGDQLGGEELALLRRFRHRARCLAMTAVSFHQVDFTFDRRVLAAGLLECRDLLHQAVGPHLTAKSHGRINHVFGHLADCDFLAALYGPAEPYRSHLRRICEGLGRMLDEGSL

SEQ ID NO: 16713 - protein, 186 aa, Homo sapiens; identical to SEQ ID NO: 16712

SEQ ID NO: 16714 - protein, 292 aa, Homo sapiens
MGKPRQNPSTLVSTLCEAEPKGKLWVNGYAGTQGTRDATLQTRLIPLSFHLQRGKGLAAPLSALSAPRLPERPADGRVAVDAQPAARSMDSDSGEQSEGEPVTAAGPDVFSSKSLALQAQKKILSKIASKTVANMLIDDTSSEIFDELYKVTKEHTHNKKEAHKIMKDLIKVAIKIGILYRNNQFSQEELVIVEKFRKKLNQTAMTIVSFYEVEYTFDRNVLSNLLHECKDLVHELVQRHLTPRTHGRINHVFNHFADVEFLSTLYSLDGDCRPNLKRICEGINKLLDEKVL

SEQ ID NO: 16715 - protein, 136 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATFRSFEGLIFNKYTLNQGRN

SEQ ID NO: 16716 - protein, 140 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATFRSFEGLMGTIKSKVSGGKRAWP

SEQ ID NO: 16717 - protein, 132 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATFRSFEGNPKGEGSRI

SEQ ID NO: 16718 - protein, 332 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGAGVNLILDCIGGSYWEKNVNCLALDGRWVLYGLMGGGDINGPLFSKLLFKRGSLITSLLRSRDNKYKQMLVNAFTEQILPHFSTEGPQRLLPVLDRIYPVTEIQEAHKYMEANKNIGKIVLELPQ

SEQ ID NO: 16719 - protein, 248 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKVQANAGECFHGANSASLLHGGPPTSAAGSGQNLPSDRNPGGP

SEQ ID NO: 16720 - protein, 332 aa, Homo sapiens; identical to SEQ ID NO: 16718

SEQ ID NO: 16721 - protein, 216 aa, Homo sapiens
FDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGKQLLLQFSRNLRDD

SEQ ID NO: 16722 - protein, 86 aa, Homo sapiens
MGSSSEASFRSAQASCSGARRQGLGRGDQNLSVMPPNGRAQTHTPGWVSDPLVLGAQVHGGCRGIEALSVSSGSWSSATVWILTVQ

SEQ ID NO: 16723 - protein, 120 aa, Homo sapiens
MGSSSEASFRSAQASCSGARRQGLGRGDQNLSVMPPNGRAQTHTPGWVSDPLVLGAQVHGGCRGIEALSVSSGSWSSATVWILTGLSRPFLPGATVLRDRPLGSAFELSYDQKKAPLRLQ

SEQ ID NO: 16724 - protein, 278 aa, Homo sapiens
  MOD_RES (144)..(144): Selenocysteine
MLRSLLLHSLRLCAQTASCLVLFPRFLGTAFMLWLLDFLCIRKHFLGRRRRGQPEPEVELNSEGEEVPPDDPPICVSDDNRLCTLASLKAVWHGQKLDFFKQAHEGGPAPNSEVVLPDGFQSQHILDYAQGNRPLVLNFGSCTCPPFMARMSAFQRLVTKYQRDVDFLIIYIEEAHPSDGWVTTDSPYIIPQHRSLEDRVSAARVLQQGAPGCALVLDTMANSSSSAYGAYFERLYVIQSGTIMYQGGRGPDGYQVSELRTWLERYDEQLHGARPRRV

SEQ ID NO: 16725 - protein, 1402 aa, Homo sapiens
MHQTLCLNPESLKMSACSDFVEHIWKPGSCKNCFCLRSDHQLVAGPPQPRAGSLPPPPRLPPRPENCRLEDEGVNSSPYSKPTIAVKPTMMSSEASDVWTEANLSAEVSQVIWRRAPGKLPLPKQEDAPVVYLGSFRGVQKPAGPSTSPDGNSRCPPAYTMVGLHNLEPRGERNIAFHPVSFPEEKAVHKEKPSFPYQDRPSTQESFRQKLAAFAGTTSGCHQGPGPLRESLPSEDDSDQRCSPSGDSEGGEYCSILDCCPGSPVAKAASQTAGSRGRHGGRDCSPTCWEQGKCSGPAEQEKRGPSFPKECCSQGPTAHPSCLGPKKLSLTSEAAISSDGLSCGSGSGSGASSPFVPHLESDYCSLMKEPAPEKQQDPGCPGVTPSRCLGLTGEPQPPAHPREATQPEPIYAESTKRKKAAPVPSKSQAKIEHAAAAQGQGQVCTGNAWAQKAASGWGRDSPDPTPQVSATITVMAAHPEEDHRTIYLSSPDSAVGVQWPRGPVSQNSEVGEEETSAGQGLSSRESHAHSASESKPKERPAIPPKLSKSSPVGSPVSPSAGGPPVSPLADLSDGSSGGSSIGPQPPSQGPADPAPSCRTNGVAISDPSRCPQPAASSASEQRRPRFQAGTWSRQCRIEEEEEVEQELLSHSWGRETKNGPTDHSNSTTWHRLHPTDGSSGQNSKVGTGMSKSASFAFEFPKDRSGIETFSPPPPPPKSRHLLKMNKSSSDLEKVSQGSAESLSPSFRGVHVSFTTGSTDSLASDSRTCSDGGPSSELAHSPTNSGKKLFAPVPFPSGSTEDVSPSGPQQPPPLPQKKIVSRAASSPDGFFWTQGSPKPGTASPKLNLSHSETNVHDESHFSYSLSPGNRHHPVFSSSDPLEKAFKGSGHWLPAAGLAGNRGGCGSPGLQCKGAPSASSSQLSVSSQASTGSTQLQLHGLLSNISSKEGTYAKLGGLYTQSLARLVAKCEDLFMGGQKKELHFNENNWSLFKLTCNKPCCDSGDAIYYCATCSEDPGSTYAVKICKAPEPKTVSYCSPSVPVHFNIQQDCGHFVASVPSSMLSSPDAPKDPVPALPTHPPAQEQDCVVVITREVPHQTASDFVRDSAASHQAEPEAYERRVCFLLLQLCNGLEHLKEHGIIHRDLCLENLLLVHCTLQAGPGPAPAPAPAPAAAAPPCSSAAPPAGGTLSPAAGPASPEGPREKQLPRLIISNFLKAKQKPGGTPNLQQKKSQARLAPEIVSASQYRKFDEFQTGILIYELLHQPNPFEVRAQLRERDYRQEDLPPLPALSLYSPGLQQLAHLLLEADPIKRIRIGEAKRVLQCLLWGPRRELVQQPGTSEEALCGTLHNWIDMKRALMMMKFAEKAVDRRRGVELEDWLCCQYLASAEPGALLQSLKLLQLL

SEQ ID NO: 16726 - protein, 1402 aa, Homo sapiens; identical to SEQ ID NO: 16725

SEQ ID NO: 16727 - protein, 471 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 16728 - protein, 260 aa, Homo sapiens
MWHAISRTSRMSQSGCPSGLLADKNISSSATRVIVKTAGNQKDFMVADDISVRQFKEMLLAHFQCQMDQLVLVFMGCLLKDHDTLSQRGIMDGHTIYLVIKSKQGSRSLAHSFRDLPTNDPCHRDRNTKANDTLNKVNHTSKANTAMISTKGQSHICATRQPAWIPALPSIELTQQLQEEYKDATVSLSSSRQTLKGDLQLSDEQSSSQITGGMMQLLMNNPYLAAQIMLFTSMPQLSEQWRQQLPTFLQQTQISDLLSA

SEQ ID NO: 16729 - protein, 475 aa, Homo sapiens
MWHAISRTSRMSQSGCPSGLLADKNISSSATRVIVKTAGNQKDFMVADDISVRQFKEMLLAHFQCQMDQLVLVFMGCLLKDHDTLSQRGIMDGHTIYLVIKSKQGSRSLAHSFRDLPTNDPCHRDRNTKGNSSRVHQPTGMNQAPVELAHFVGSDAPKVHTQNLEVSHPECKAQMLENPSIQRLLSNMEFMWQFISEHLDTQQLMQQNPEVSRLLLDNSEILLQTLELARNLAMIQEIMQIQQPSQNLEYPLNPQPYLGLETMPGGNNALGQNYADINDQMLNSMQDPFGGNPFTALLAGQVLEQVQSSPPPPPPSQEQQDQLTQHPATRVIYNSSGGFSSNTSANDTLNKVNHTSKANTAMISTKGQSHICATRQPAWIPALPSIELTQQLQEEYKDATVSLSSSRQTLKGDLQLSDEQSSSQITGGMMQLLMNNPYLAAQIMLFTSMPQLSEQWRQQLPTFLQQTQISDLLSA

SEQ ID NO: 16730 - protein, 381 aa, Homo sapiens
MNALDGVPFKLPKGFVIGTEPLPGPELSVPACGEVLLGSMHDFSLERTALFWVEAAGQGPSPYQCGDPGTASAPPAWLLLVSPEHGLAPAPTTIRDPEAGHQERPEEEGEDEAEASSGSEEEPAPSSLQPGSPASPGPGRRLCSLDVLRGVRLELAGARRRLSEGKLVSRPRALLHGLRGHRALSLCPSPAQSPRSASPPGPAPQHPAAPASPPRPSTAGAIPPLRSHKPTVASLSPYTCLPPLGGAPQPLNPHKSHPDTAADLLSALSQEEQDLIGPVVALGYPLRRAIIALQKTGRQSLSQFLSYLSACDRLLRQGYEEGLVDEAMEMFQFSESQAGEFLRLWEQFSDMGFQQDRIKEVLLVHGNRREQALEELVACAQ

SEQ ID NO: 16731 - protein, 381 aa, Homo sapiens; identical to SEQ ID NO: 16730

SEQ ID NO: 16732 - protein, 581 aa, Homo sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKKHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTSSATAEPITDPPHSPAALRESCTATWSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSPAPCSPSLKPPNLPTLSILDKLNPEERGGLGQGLSWAGENTRARIWEPSALS

SEQ ID NO: 16733 - protein, 1119 aa, Homo sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 16734 - protein, 325 aa, Homo sapiens
MANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDSKYSSKLLLSWLVPTKQRKRIAHVMWKTPVGQWLIR

SEQ ID NO: 16735 - protein, 358 aa, Homo sapiens
MNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 16736 - protein, 1119 aa, Homo sapiens; identical to SEQ ID NO: 16733

SEQ ID NO: 16737 - protein, 852 aa, Homo sapiens
MDSKGLGRILWKSGQQKTGLKIIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 16738 - protein, 340 aa, Homo sapiens
MEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSH

SEQ ID NO: 16739 - protein, 412 aa, Homo sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKL

SEQ ID NO: 16740 - protein, 686 aa, Homo sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSMPVWRAPLPTSPQPPSPRQRPPSQVPHPQAPACPVA

SEQ ID NO: 16741 - protein, 276 aa, Homo sapiens
EKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSH

SEQ ID NO: 16742 - protein, 1028 aa, Homo sapiens
MRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 16743 - protein, 1119 aa, Homo sapiens; identical to SEQ ID NO: 16733

SEQ ID NO: 16744 - protein, 874 aa, Homo sapiens
MRLAQVIFDKNDSDFEAKVKQLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 16745 - protein, 530 aa, Homo sapiens
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHPSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQQNTGPLVYVLYAVLVHAGWSCHNGHYFSYVKAQEGQWYKMDDAEVTAASITSVLSQQAYVLFYIQKSEWERHSESVSRGREPRALGAEDTDRRATQGELKRDHPCLQAPELDEHLVERATQESTLDRWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQ

SEQ ID NO: 16746 - protein, 227 aa, Homo sapiens
MGNCVGRQRRERPAAPGHPRKRAGRNEPLKKERLKWKSDYPMTDGQLRSKRDEFWDTAPAFEGRKEIWDALKAAAYAAEANDHELAQAILDGASITLPHGTLCECYDELGNRYQLPIYCLSPPVNLLLEHTEEESLEPPEPPPSVRREFPLKVRLSTGKDVRLSASLPDTVGQLKRQLHAQEGIEPSWQRWFFSGKLLTDRTRLQETKIQKDFVIQVIINQPPPPQD

SEQ ID NO: 16747 - protein, 533 aa, Homo sapiens
MGSRCLNPPPPAHSDTTGKDSFGNIRGAETGQGASACSVTSARVTCGAGSEPHSHRNPGISAQVGLAPSYGAARGRRRPLALQQSPQERRHVGWNSTRGLLPASLPGTASSQSASATASAALPLKVTGPLARNPTPPWTAAAALATRGQRPEKGLFPGPAPFSLGKRKRGRGRTWERRRRVSIETSTCFRPGCERLGAAAGANLSQLASSQRPLRERWVLYTIIMAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 16748 - protein, 309 aa, Homo sapiens
MAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 16749 - protein, 186 aa, Homo sapiens
MQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 16750 - protein, 708 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLESLFECPWPLVINAESC

SEQ ID NO: 16751 - protein, 244 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQCCDGLFPDLVSYAPHNNPVRWSVGRSWYDWQLSR

SEQ ID NO: 16752 - protein, 1068 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 16753 - protein, 1068 aa, Homo sapiens; identical to SEQ ID NO: 16752

SEQ ID NO: 16754 - protein, 151 aa, Homo sapiens
MFSTPELQRLISGDNAEIDLEDLKKHTVYYGGFHGSHRVIIWLWDILASDFTPDERAMFLKFVTSCSRPPLLGFAYLKPPFSIRCVEVSDDQQGRQLDPSEPSEEGPTVLTAGEPASPRETAHGLSPLSAAPFSFLPQGRVPGVGVGTCCF

SEQ ID NO: 16755 - protein, 244 aa, Homo sapiens; identical to SEQ ID NO: 16751

SEQ ID NO: 16756 - protein, 338 aa, Homo sapiens
MKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQAVHVQARCFISSLAKGEGKPSGLRSSVCLKPGPLWVLK

SEQ ID NO: 16757 - protein, 872 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVT

SEQ ID NO: 16758 - protein, 244 aa, Homo sapiens; identical to SEQ ID NO: 16751

SEQ ID NO: 16759 - protein, 981 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKSPGASNFSTLPKISPSSLSNNYNNMNNRNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 16760 - protein, 952 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 16761 - protein, 956 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLFIVLVIEQKNEDGTWPRGPSTPNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 16762 - protein, 235 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKKPLEQSC

SEQ ID NO: 16763 - protein, 922 aa, Homo sapiens
MISLKVCGFIQIWSQKTGMTKLKEALIETVQRQKEIKLVVTFKSGKFIRIFQLSNNIRSVVLRHCKKRQSHLRLTLKNNVFLFIDKLSYRDAKQLNMFLDIIHQNKSQQPMKSDDDWSVFESRNMLKEIDKTSFYSICNKPSYQKMPLFMSKSPTHVKKGILENQGGKGQNTLSSDVQTNEDILKEDNPVPNKKYKTDSLKYIQSNRKNPSSLEDLEKDRDLKLGPSFNTNCNGNPNLDETVLATQTLNAKNGLTSPLEPEHSQGDPRCNKAQVPLDSHSQQLQQGFPNLGNTCYMNAVLQSLFAIPSFADDLLTQGVPWEYIPFEALIMTLTQLLALKDFCSTKIKRELLGNVKKVISAVAEIFSGNMQNDAHEFLGQCLDQLKEDMEKLNATLNTGKECGDENSSPQMHVGSAATKVFVCPVVANFEFELQLSLICKACGHAVLKVEPNNYLSINLHQETKPLPLSIQNSLDLFFKEEELEYNCQMCKQKSCVARHTFSRLSRVLIIHLKRYSFNNAWLLVKNNEQVYIPKSLSLSSYCNESTKPPLPLSSSAPVGKCEVLEVSQEMISEINSPLTPSMKLTSESSDSLVLPVEPDKNADLQRFQRDCGDASQEQHQRDLENGSALESELVHFRDRAIGEKELPVADSLMDQGDISLPVMYEDGGKLISSPDTRLVEVHLQEVPQHPELQKYEKTNTFVEFNFDSVTESTNGFYDCKENRIPEGSQGMAEQLQQCIEESIIDEFLQQAPPPGVRKLDAQEHTEETLNQSTELRLQKADLNHLGALGSDNPGNKNILDAENTRGEAKELTRNVKMGDPLQAYRLISVVSHIGSSPNSGHYISDVYDFQKQAWFTYNDLCVSEISETKMQEARLHSGYIFFYMHNGIFEELLRKAENSRLPSTQAGVIPQGEYEGDSLYRPA

SEQ ID NO: 16764 - protein, 1352 aa, Homo sapiens
MSKVTAPGSGPPAAASGKEKRSFSKRLFRSGRAGGGGAGGPGASGPAAPSSPSSPSSARSVGSFMSRVLKTLSTLSHLSSEGAAPDRGGLRSCFPPGPAAAPTPPPCPPPPASPAPPACAAEPVPGVAGLRNHGNTCFMNATLQCLSNTELFAEYLALGQYRAGRPEPSPDPEQPAGRGAQGQGEVTEQLAHLVRALWTLEYTPQHSRDFKTIVSKNALQYRGNSQHDAQEFLLWLLDRVHEDLNHSVKQSGQPPLKPPSETDMMPEGPSFPVCSTFVQELFQAQYRSSLTCPHCQKQSNTFDPFLCISLPIPLPHTRPLYVTVVYQGKCSHCMRIGVAVPLSGTVARLREAVSMETKIPTDQIVLTEMYYDGFHRSFCDTDDLETVHESDCIFAFETPEIFRPEGILSQRGIHLNNNLNHLKFGLDYHRLSSPTQTAAKQGKMDSPTSRAGSDKIVLLVCNRACTGQQGKRFGLPFVLHLEKTIAWDLLQKEILEKMKYFLRPTVCIQVCPFSLRVVSVVGITYLLPQEEQPLCHPIVERALKSCGPGGTAHVKLVVEWDKETRDFLFVNTEDEYIPDAESVRLQRERHHQPQTCTLSQCFQLYTKEERLAPDDAWRCPHCKQLQQGSITLSLWTLPDVLIIHLKRFRQEGDRRMKLQNMVKFPLTGLDMTPHVVKRSQSSWSLPSHWSPWRRPYGLGRDPEDYIYDLYAVCNHHGTMQGGHYTAYCKNSVDGLWYCFDDSDVQQLSEDEVCTQTAYILFYQRRTAIPSWSANSSVAGSTSSSLCEHWVSRLPGSKPASVTSAASSRRTSLASLSESVEMTGERSEDDGGFSTRPFVRSVQRQSLSSRSSVTSPLAVNENCMRPSWSLSAKLQMRSNSPSRFSGDSPIHSSASTLEKIGEAADDKVSISCFGSLRNLSSSYQEPSDSHSRREHKAVGRAPLAVMEGVFKDESDTRRLNSSVVDTQSKHSAQGDRLPPLSGPFDNNNQIAYVDQSDSVDSSPVKEVKAPSHPGSLAKKPESTTKRSPSSKGTSEPEKSLRKGRPALASQESSLSSTSPSSPLPVKVSLKPSRSRSKADSSSRGSGRHSSPAPAQPKKESSPKSQDSVSSPSPQKQKSASALTYTASSTSAKKASGPATRSPFPPGKSRTSDHSLSREGSRQSLGSDRASATSTSKPNSPRVSQARAGEGRGAGKHVRSSSMASLRSPSTSIKSGLKRDSKSEDKGLSFFKSALRQKETRRSTDLGKTALLSKKAGGSSVKSVCKNTGDDEAERGHQPPASQQPNANTTGKEQLVTKDPASAKHSLLSARKSKSSQLDSGVPSSPGGRQSAEKSSKKLSSSMQTSARPSQKPQ

SEQ ID NO: 16765 - protein, 443 aa, Homo sapiens
MSQRDGVCGSHEVAGAASPGADGGLSLAAYCKNSVDGLWYCFDDSDVQQLSEDEVCTQTAYILFYQRRTAIPSWSANSSVAGSTSSSLCEHWVSRLPGSKPASVTSAASSRRTSLASLSESVEMTGERSEDDGGFSTRPFVRSVQRQSLSSRSSVTSPLAVNENCMRPSWSLSAKLQMRSNSPSRFSGDSPIHSSASTLEKIGEAADDKVSISCFGSLRNLSSSYQEPSDSHSRREHKAVGRAPLAVMEGVFKDESDTRRLNSSVVDTQSKHSAQGDRLPPLSGPFDNNNQIAYVDQSDSVDSSPVKEVKAPSHPGSLAKKPESTTKRSPSSKGTSEPEKSLRKGRPALASQESSLSSTSPSSPLPVKVSLKPSRSRSKADSSSRGSGRHSSPAPAQTQFPSGEPGPSRGGQGGREARAELLHGQPALPQHKHQVWFEEGQQV

SEQ ID NO: 16766 - protein, 3394 aa, Homo sapiens
MRRKNSYYVWQIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGMSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSNDGFNWKELLKIKSAHKLLYALEIIEALGKPNRRIRRESTGSYSDLYPDSDDSSEDQVENSKNSWSCKFVAAGGLQQLLEIFNSGILEPKEQESWTVWQLDCLACLLKLICQFAVDPSDLDLAYHDVFAWSGIAESHRKRTWPGKSRKAAGDHAKGLHIPRLTEVFLVLVQGTSLIQRLMSVAYTYDNLAPRVLKAQSDHRSRHEVSHYSMWLLVSWAHCCSLVKSSLADSDHLQDWLKKLTLLIPETAVRHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQEFLRDIFNLLFLLPSLKDRQQPKCKSHSSRAAAYDLLVEMVKGSVENYRLIHNWVMAQHMQSHAPYKWDYWPHEDVRAECRFVGLTNLGATCYLASTIQQLYMIPEARQAVFTAKYSEDMKHKTTLLELQKMFTYLMESECKAYNPRPFCKTYTMDKQPLNTGEQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTSAAYLLVSLIPSNSFRQMFRSTRSLHIPTRDLPLSPDTTVVLHQVYNVLLGLLSRAKLYVDAAVHGTTKLVPYFSFMTYCLISKTEKLMFSTYFMDLWNLFQPKLSEPAIATNHNKQALLSFWYNVCADCPENIRLIVQNPVVTKNIAFNYILADHDDQDVVLFNRGMLPAYYGILRLCCEQSPAFTRQLASHQNIQWAFKNLTPHASQYPGAVEELFNLMQLFIAQRPDMREEELEDIKQFKKTTISCYLRCLDGRSCWTTLISAFRILLESDEDRLLVVFNRGLILMTESFNTLHMMYHEATACHVTGDLVELLSIFLSVLKSTRPYLQRKDVKQALIQWQERIEFAHKLLTLLNSYSPPELRNACIDVLKELVLLSPHDFLHTLVPFLQHNHCTYHHSNIPMSLGPYFPCRENIKLIGGKSNIRPPRPELNMCLLPTMVETSKGKDDVYDRMLLDYFFSYHQFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 16767 - protein, 3311 aa, Homo sapiens
MRRKNSYYVWQIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGMSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSNDGFNWKELLKIKSAHKLLYALEIIEALGKPNRRIRRESTGSYSDLYPDSDDSSEDQVENSKNSWSCKFVAAGGLQQLLEIFNSGILEPKEQESWTVWQLDCLACLLKLICQFAVDPSDLDLAYHDVFAWSGIAESHRKRTWPGKSRKAAGDHAKGLHIPRLTEVFLVLVQGTSLIQRLMSVAYTYDNLAPRVLKAQSDHRSRHEVSHYSMWLLVSWAHCCSLVKSSLADSDHLQDWLKKLTLLIPETAVRHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQEFLRDIFNLLFLLPSLKDRQQPKCKSHSSRAAAYDLLVEMVKGSVENYRLIHNWVMAQHMQSHAPYKWDYWPHEDVRAECRFVGLTNLGATCYLASTIQQLYMIPEARQAVFTAKYSEDMKHKTTLLELQKMFTYLMESECKAYNPRPFCKTYTMDKQPLNTGEQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTSAAYLLVSLIPSNSFRQMFRSTRSLHIPTRDLPLSPDTTVVLHQVYNVLLGLLSRAKLYVDAAVHGTTKLVPYFSFMTYCLISKTEKLMFSTYFMDLWNLFQPKLSEPAIATNHNKQALLSFWYNVCADCPENIRLIVQNPVVTKNIAFNYILADHDDQDVVLFNRGMLPAYYGILRLCCEQSPAFTRQLASHQNIQWAFKNLTPHASQYPGAVEELFNLMQLFIAQRPDMREEELEDIKQFKKTTISCYLRCQALIQWQERIEFAHKLLTLLNSYSPPELRNACIDVLKELVLLSPHDFLHTLVPFLQHNHCTYHHSNIPMSLGPYFPCRENIKLIGGKSNIRPPRPELNMCLLPTMVETSKGKDDVYDRMLLDYFFSYHQFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 16768 - protein, 3546 aa, Homo sapiens
MCENCADLVEVLNEISDVEGGDGLQLRKEHTLKIFTYINSWTQRQCLCCFKEYKHLEIFNQVVCALINLVIAQVQVLRDQLCKHCTTINIDSTWQDESNQAEEPLNIDRECNEGSTERQKSIEKKSNSTRICNLTEEESSKSSDPFSLWSTDEKEKLLLCVAKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGMSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSNDGFNWKELLKIKSAHKLLYALEIIEALGKPNRRIRRESTGSYSDLYPDSDDSSEDQVENSKNSWSCKFVAAGGLQQLLEIFNSGILEPKEQESWTVWQLDCLACLLKLICQFAVDPSDLDLAYHDVFAWSGIAESHRKRTWPGKSRKAAGDHAKGLHIPRLTEVFLVLVQGTSLIQRLMSVAYTYDNLAPRVLKAQSDHRSRHEVSHYSMWLLVSWAHCCSLVKSSLADSDHLQDWLKKLTLLIPETAVRHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQEFLRDIFNLLFLLPSLKDRQQPKCKSHSSRAAAYDLLVEMVKGSVENYRLIHNWVMAQHMQSHAPYKWDYWPHEDVRAECRFVGLTNLGATCYLASTIQQLYMIPEARQAVFTAKYSEDMKHKTTLLELQKMFTYLMESECKAYNPRPFCKTYTMDKQPLNTGEQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTSAAYLLVSLIPSNSFRQMFRSTRSLHIPTRDLPLSPDTTVVLHQVYNVLLGLLSRAKLYVDAAVHGTTKLVPYFSFMTYCLISKTEKLMFSTYFMDLWNLFQPKLSEPAIATNHNKQALLSFWYNVCADCPENIRLIVQNPVVTKNIAFNYILADHDDQDVVLFNRGMLPAYYGILRLCCEQSPAFTRQLASHQNIQWAFKNLTPHASQYPGAVEELFNLMQLFIAQRPDMREEELEDIKQFKKTTISCYLRCLDGRSCWTTLISAFRILLESDEDRLLVVFNRGLILMTESFNTLHMMYHEATACHVTGDLVELLSIFLSVLKSTRPYLQRKDVKQALIQWQERIEFAHKLLTLLNSYSPPELRNACIDVLKELVLLSPHDFLHTLVPFLQHNHCTYHHSNIPMSLGPYFPCRENIKLIGGKSNIRPPRPELNMCLLPTMVETSKGKDDVYDRMLLDYFFSYHQFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 16769 - protein, 604 aa, Homo sapiens
MPGLRRRASWRVSIPGSWPSQTRARLVSSTWATHAMSTASFRPYSWRLSSFRHCVLRLTENNSQPLMTKLQWLFGFLEHSQRPAISPENFLSASWTPWFSPGTQQDCSEYLKYLLDRLHEEEKTGTRICQKLKQSSSPSPPEEPPAPSSTSVEKMFGGKIVTRICCLCCLNVSSREEAFTDLSLAFPPPERCRRRRLGSVMRPTEDITARELPPPTSAQGPGRVGPRRQRKHCITEDTPPTSLYIEGLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAASLGTADRPEPENQWYLFNDTRVSFSSFESVSNVTSFFPKDTAYVLFYRQRPREGPEAELGSSRVRTEPTLHKDLMEAISKDNILYLQEQEKEARSRAAYISALPTSPHWGRGFDEDKDEDEGSPGGCNPAGGNGGDFHRLVF

SEQ ID NO: 16770 - protein, 1018 aa, Homo sapiens
MDKILEAVVTSSYPVSVKQGLVRRVLEAARQPLEREQCLALLALGARLYVGGAEELPRRVGCQLLHVAGRHHPDVFAEFFSARRVLRLLQGGAGPPGPRALACVQLGLQLLPEGPAADEVFALLRREVLRTVCERPGPAACAQVARLLARHPRCVPDGPHRLLFCQQLVRCLGRFRCPAEGEEGAVEFLEQAQQVSGLLAQLWRAQPAAILPCLKELFAVISCAEEEPPSSALASVVQHLPLELMDGVVRNLSNDDSVTDSQMLTAISRMIDWVSWPLGKNIDKWIIALLKGLAAVKKFSILIEVSLTKIEKVFSKLLYPIVRGAALSVLKYMLLTFQHSHEAFHLLLPHIPPMVASLVKEDSNSGTSCLEQLAELVHCMVFRFPGFPDLYEPVMEAIKDLHVPNEDRIKQLLGQDAWTSQKSELAGFYPRLMAKSDTGKIGLINLGNTCYVNSILQALFMASDFRHCVLRLTENNSQPLMTKLQWLFGFLEHSQRPAISPENFLSASWTPWFSPGTQQDCSEYLKYLLDRLHEEEKTGTRICQKLKQSSSPSPPEEPPAPSSTSVEKMFGGKIVTRICCLCCLNVSSREEAFTDLSLAFPPPERCRRRRLGSVMRPTEDITARELPPPTSAQGPGRVGPRRQRKHCITEDTPPTSLYIEGLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAASLGTADRPEPENQWYLFNDTRVSFSSFESVSNVTSFFPKDTAYVLFYRQRPREGPEAELGSSRVRTEPTLHKDLMEAISKDNILYLQEQEKEARSRAAYISALPTSPHWGRGFDEDKDEDEGSPGGCNPAGGNGGDFHRLVF

SEQ ID NO: 16771 - protein, 1042 aa, Homo sapiens
MDKILEGLVSSSHPLPLKRVIVRKVVESAEHWLDEAQCEAMFDLTTRLILEGQDPFQRQVGHQVLEAYARYHRPEFESFFNKTFVLGLLHQGYHSLDRKDVAILDYIHNGLKLIMSCPSVLDLFSLLQVEVLRMVCERPEPQLCARLSDLLTDFVQCIPKGKLSITFCQQLVRTIGHFQCVSTQERELREYVSQVTKVSNLLQNIWKAEPATLLPSLQEVFASISSTDASFEPSVALASLVQHIPLQMITVLIRSLTTDPNVKDASMTQALCRMIDWLSWPLAQHVDTWVIALLKGLAAVQKFTILIDVTLLKIELVFNRLWFPLVRPGALAVLSHMLLSFQHSPEAFHLIVPHVVNLVHSFKNDGLPSSTAFLVQLTELIHCMMYHYSGFPDLYEPILEAIKDFPKPSEEKIKLILNQSAWTSQSNSLASCLSRLSGKSETGKTGLINLGNTCYMNSVIQALFMATDFRRQVLSLNLNGCNSLMKKLQHLFAFLAHTQREAYAPRIFFEASRPPWFTPRSQQDCSEYLRFLLDRLHEEEKILKVQASHKPSEILECSETSLQEVASKAAVLTETPRTSDGEKTLIEKMFGGKLRTHIRCLNCRSTSQKVEAFTDLSLAFCPSSSLENMSVQDPASSPSIQDGGLMQASVPGPSEEPVVYNPTTAAFICDSLVNEKTIGSPPNEFYCSENTSVPNESNKILVNKDVPQKPGGETTPSVTDLLNYFLAPEILTGDNQYYCENCASLQNAEKTMQITEEPEYLILTLLRFSYDQKYHVRRKILDNVSLPLVLELPVKRITSFSSLSESWSVDVDFTDLSENLAKKLKPSGTDEASCTKLVPYLLSSVVVHSGISSESGHYYSYARNITSTDSSYQMYHQSEALALASSQSHLLGRDSPSAVFEQDLENKEMSKEWFLFNDSRVTFTSFQSVQKITSRFPKDTAYVLLYKKQHSTNGLSGNNPTSGLWINGDPPLQKELMDAITKDNKLYLQEQELNARARALQAASASCSFRPNGFDDNDPPGSCGPTGGGGGGGFNTVGRLVF

SEQ ID NO: 16772 - protein, 1235 aa, Homo sapiens
MFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYIYDLFSVIIHKGGCYGGHYHVYIKDVDHLGNWQFQEEKSKPDVNLKDLQSEEEIDHPLMILKAILLEENNLIPVDQLGQKLLKKIGISWNKKYRKQHGPLRKFLQLHSQIFLLSSDESTVRLLKNSSLQAESDFQRNDQQIFKMLPPESPGLNNSISCPHWFDINDSKVQPIREKDIEQQFQGKESAYMLFYRKSQLQRPPEARANPRYGVPCHLLNEMDAANIELQTKRAECDSANNTFELHLHLGPQYHFFNGALHPVVSQTESVWDLTFDKRKTLGDLRQSIFQLLEFWEGDMVLSVAKLVPAGLHIYQSLGGDELTLCETEIADGEDIFVWNGVEVGGVHIQTGIDCEPLLLNVLHLDTSSDGEKCCQVIESPHVFPANAEVGTVLTALAIPAGVIFINSAGCPGGEGWTAIPKEDMRKTFREQGLRNGSSILIQDSHDDNSLLTKEEKWVTSMNEIDWLHVKNLCQLESEEKQVKISATVNTMVFDIRIKAIKELKLMKELADNSCLRPIDRNGKLLCPVPDSYTLKEAELKMGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 16773 - protein, 163 aa, Homo sapiens
MGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGENRMGFQQPVHHKEK

SEQ ID NO: 16774 - protein, 1235 aa, Homo sapiens; identical to SEQ ID NO: 16772

SEQ ID NO: 16775 - protein, 328 aa, Homo sapiens
MFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYMTSSQLLYTKVAATEAITMYILKMLIIWETGSFKRKKVNQM

SEQ ID NO: 16776 - protein, 1247 aa, Homo sapiens
MSLFLRVVFSFTMFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYIYDLFSVIIHKGGCYGGHYHVYIKDVDHLGNWQFQEEKSKPDVNLKDLQSEEEIDHPLMILKAILLEENNLIPVDQLGQKLLKKIGISWNKKYRKQHGPLRKFLQLHSQIFLLSSDESTVRLLKNSSLQAESDFQRNDQQIFKMLPPESPGLNNSISCPHWFDINDSKVQPIREKDIEQQFQGKESAYMLFYRKSQLQRPPEARANPRYGVPCHLLNEMDAANIELQTKRAECDSANNTFELHLHLGPQYHFFNGALHPVVSQTESVWDLTFDKRKTLGDLRQSIFQLLEFWEGDMVLSVAKLVPAGLHIYQSLGGDELTLCETEIADGEDIFVWNGVEVGGVHIQTGIDCEPLLLNVLHLDTSSDGEKCCQVIESPHVFPANAEVGTVLTALAIPAGVIFINSAGCPGGEGWTAIPKEDMRKTFREQGLRNGSSILIQDSHDDNSLLTKEEKWVTSMNEIDWLHVKNLCQLESEEKQVKISATVNTMVFDIRIKAIKELKLMKELADNSCLRPIDRNGKLLCPVPDSYTLKEAELKMGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 16777 - protein, 357 aa, Homo sapiens
MDGVLFRAHQCQYVHPCVHVYVTVGLMDPLCLQRHKEHAKGREPPCPALSTSGLVGLHNIGQTCCLNSLIQVFVMNVDFARILKRITVPRGADEQRRSVPFQMLLLLEKMQDSRQKAVWPLELAYCLQKYNVPLFVQHDAAQLYLKLWNLIKDQIADVHLVERLQALYMIRMKDSLICLDCAMESSRNSSMLTLRLSFFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYH

SEQ ID NO: 16778 - protein, 1316 aa, Homo sapiens
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTCHAEGFCMMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKITISIHNKLPVRQCQSQPNLHSNSLENPTKPVPSSTITNSAVQSTSNASTMSVSSKVTKPIPRSESCSQPVMNGKSKLNSSVLVPYGAESSEDSDEESKGLGKENGIGTIVSSHSPGQDAEDEEATPHELQEPMTLNGANSADSDSDPKENGLAPDGASCQGQPALHSENPFAKANGLPGKLMPAPLLSLPEDKILETFRLSNKLKGSTDEMSAPGAERGPPEDRDAEPQPGSPAAESLEEPDAAAGLSSTKKAPPPRDPGTPATKEGAWEAMAVAPEEPPPSAGEDIVGDTAPPDLCDPGSLTGDASPLSQDAKGMIAEGPRDSALAEAPEGLSPAPPARSEEPCEQPLLVHPSGDHARDAQDPSQSLGAPEAAERPPAPVLDMAPAGHPEGDAEPSPGERVEDAAAPKAPGPSPAKEKIGSLRKVDRGHYRSRRERSSSGEPARESRSKTEGHRHRRRRTCPRERDRQDRHAPEHHPGHGDRLSPGERRSLGRCSHHHSRHRSGVELDWVRHHYTEGERGWGREKFYPDRPRWDRCRYYHDRYALYAARDWKPFHGGREHERAGLHERPHKDHNRGRRGCEPARERERHRPSSPRAGAPHALAPHPDRFSHDRTALVAGDNCNLSDRFHEHENGKSRKRRHDSVENSDSHVEKKARRSEQKDPLEEPKAKKHKKSKKKKKSKDKHRDRDSRHQQDSDLSAACSDADLHRHKKKKKKKKRHSRKSEDFVKDSELHLPRVTSLETVAQFRRAQGGFPLSGGPPLEGVGPFREKTKHLRMESRDDRCRLFEYGQGD

SEQ ID NO: 16779 - protein, 1123 aa, Homo sapiens
MDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKNAVSKYGSQFQGNSQHDALEFLLWLLDRVHEDLEGSSRGPVSEKLPPEATKTSENCLSPSAQLPLGQSFVQSHFQAQYRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 16780 - protein, 1118 aa, Homo sapiens
MDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKNAVSKYGSQFQGNSQHDALEFLLWLLDRVHEDLEGSSRGPVSEKLPPEATKTSENCLSPSAQLPLGQSFVQSHFQAQYRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 16781 - protein, 814 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKRIQASILKAFNNPTTKTADDETRKKVKAYGKEGVKMNFIDRIFIGELTSTVMCEECANISTVKDPFIDISLPIIEERVSKPLLWGRMNKYRSLRETDHDRYSGNVTIENIHQPRAAKKHSSSKDKSQLIHDRKCIRKLSSGETVTYQKNENLEMNGDSLMFASLMNSESRLNESPTDDSEKEASHSESNVDADSEPSESESASKQTGLFRSSSGSGVQPDGPLYPLSAGKLLYTKETDSGDKEMAEAISELRLSSTVTGDQDFDRENQPLNISNNLCFLEGKHLRSYSPQNAFQTLSQSYITTSKECSIQSCLYQFTSMELLMGNNKLLCENCTKNKQKYQEETSFAEKKVEGVYTNARKQLLISAVPAVLILHLKRFHQAGLSLRKVNRHVDFPLMLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 16782 - protein, 289 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKWVHLHLI

SEQ ID NO: 16783 - protein, 182 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTRPGPILIHLFSINCLGAHSESVC

SEQ ID NO: 16784 - protein, 494 aa, Homo sapiens
MRSKKVVQNSRFFLPQTLSWAPRFKDFQQQDSQELLHYLLDAVRTEETKISTVKDPFIDISLPIIEERVSKPLLWGRMNKYRSLRETDHDRYSGNVTIENIHQPRAAKKHSSSKDKSQLIHDRKCIRKLSSGETVTYQKNENLEMNGDSLMFASLMNSESRLNESPTDDSEKEASHSESNVDADSEPSESESASKQTGLFRSSSGSGVQPDGPLYPLSAGKLLYTKETDSGDKEMAEAISELRLSSTVTGDQDFDRENQPLNISNNLCFLEGKHLRSYSPQNAFQTLSQSYITTSKECSIQSCLYQFTSMELLMGNNKLLCENCTKNKQKYQEETSFAEKKVEGVYTNARKQLLISAVPAVLILHLKRFHQAGLSLRKVNRHVDFPLMLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 16785 - protein, 289 aa, Homo sapiens; identical to SEQ ID NO: 16782

SEQ ID NO: 16786 - protein, 814 aa, Homo sapiens; identical to SEQ ID NO: 16781

SEQ ID NO: 16787 - protein, 52 aa, Homo sapiens
MRVKDPTKALPEKAKRSKRPTVPHDEDSSDDIAVGLTCQHVSHAISVNHVKR

SEQ ID NO: 16788 - protein, 107 aa, Homo sapiens
MLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 16789 - protein, 640 aa, Homo sapiens
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKKEEARRRRREVKRRLLEELASTPPRKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSKRRKSNPKPLVLSEARKQLMIYRLPQVLRLHLKRFRWSGRNHREKIGVHVVFDQVLTMEPYCCRDMLSSLDKETFAYDLSAVVMHHGKGFGSGHYTAYCYNTEGGACALLCGVGDTERG

SEQ ID NO: 16790 - protein, 640 aa, Homo sapiens; identical to SEQ ID NO: 16789

SEQ ID NO: 16791 - protein, 688 aa, Homo sapiens
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKKEEARRRRREVKRRLLEELASTPPRKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSKRRKSNPKPLVLSEARKQLMIYRLPQVLRLHLKRFRWSGRNHREKIGVHVVFDQVLTMEPYCCRDMLSSLDKETFAYDLSAVVMHHGKGFGSGHYTAYCYNTEGGFWVHCNDSKLNVCSVEEVCKTQAYILFYTQRTVQGNARISETHLQAQVQSSNNDEGRPQTFS

SEQ ID NO: 16792 - protein, 688 aa, Homo sapiens; identical to SEQ ID NO: 16791

SEQ ID NO: 16793 - protein, 15 aa, Homo sapiens
MDRCKHVGRLRLAQD

SEQ ID NO: 16794 - protein, 37 aa, Homo sapiens
MDRCKHVGRLRLAQDHSILNPQKWCCLECATTESVWA

SEQ ID NO: 16795 - protein, 334 aa, Homo sapiens
MTSQPSLPADDFDIYHVLAECTDYYDTLPVKEADGNQPHFQGVTGLWNLGNTCCVNAISQCLCSILPLVEYFLTGKYITALQNDCSEVATAFAYLMTDMWLGDSDCVSPEIFWSALGNLYPAFTKKMQQDAQEFLICVLNELHEALKKYHYSRRRSYEKGSTQRCCRKWITTETSIITQLFEEQLNYSIVCLKCEKCTYKNEVFTVFSLPIPSKYECSLRDCLQCFFQQDALTWNNEIHCSFCETKQETAVRASISKAPKIIIFHLKRFDIQGTTKRKLRTDIHYPLTNLDLTPYICSIFRKYPKYNLCAVVNHFGDLDGGHYTAFCKNSVTQA

SEQ ID NO: 16796 - protein, 711 aa, Homo sapiens
MAQVRETSLPSGSGVRWISGGGGGASPEEAVEKAGKMEEAAAGATKASSRREAEEMKLEPLQEREPAPEENLTWSSSGGDEKVLPSIPLRCHSSSSPVCPRRKPRPRPQPRARSRSQPGLSAPPPPPARPPPPPPPPPPPAPRPRAWRGSRRRSRPGSRPQTRRSCSGDLDGSGDPGGLGDWLLEVEFGQGPTGCSHVESFKVGKNWQKNLRLIYQRFVWSGTPETRKRKAKSCICHVCSTHMNRLHSCLSCVFFGCFTEKHIHKHAETKQHHLAVDLYHGVIYCFMCKDYVYDKDIEQIAKETKEKILRLLTSTSTDVSHQQFMTSGFEDKQSTCETKEQEPKLVKPKKKRRKKSVYTVGLRGLINLGNTCFMNCIVQALTHIPLLKDFFLSDKHKCIMTSPSLCLVCEMSSLFHAMYSGSRTPHIPYKLLHLIWIHAEHLAGYRQQDAHEFLIAILDVLHRHSKDDSGGQEANNPNCCNCIIDQIFTGGLQSDVTCQACHSVSTTIDPCWDISLDLPGSCATFDSQNPERADSTVSRDDHIPGIPSLTDCLQWFTRPEHLGSSAKIKCNSCQSYQESTKQLTMKKLPIVACFHLKRFEHVGKQRRKINTFISFPLELDMTPFLASTKESRMKEGQPPTDCVPNENKYSLFAVINHHGTLESGHYTSFIRQQKDQWFSCDDAIITKATIEDLLYSEGYLLFYHKQGLEKD

SEQ ID NO: 16797 - protein, 1073 aa, Homo sapiens
MAWVKFLRKPGGNLGKVYQPGSMLSLAPTKGLLNEPGQNSCFLNSAVQVLWQLDIFRRSLRVLTGHVCQGDACIFCALKTIFAQFQHSREKALPSDNIRHALAESFKDEQRFQLGLMDDAAECFENMLERIHFHIVPSRDADMCTSKSCITHQKFAMTLYEQCVCRSCGASSDPLPFTEFVRYISTTALCNEVERMLERHERFKPEMFAELLQAANTTDDYRKCPSNCGQKIKIRRVLMNCPEIVTIGLVWDSEHSDLTEAVVRNLATHLYLPGLFYRVTDENAKNSELNLVGMICYTSQHYCAFAFHTKSSKWVFFDDANVKEIGTRWKDVVSKCIRCHFQPLLLFYANPDGTAVSTEDALRQVISWSHYKSVAENMGCEKPVIHKSDNLKENGFGDQAKQRENQKFPTDNISSSNRSHSHTGVGKGPAKLSHIDQREKIKDISRECALKAIEQKNLLSSQRKDLEKGQRKDLGRHRDLVDEDLSHFQSGSPPAPNGFKQHGNPHLYHSQGKGSYKHDRVVPQSRASAQIISSSKSQILAPGEKITGKVKSDNGTGYDTDSSQDSRDRGNSCDSSSKSRNRGWKPMRETLNVDSIFSESEKRQHSPRHKPNISNKPKSSKDPSFSNWPKENPKQKGLMTIYEDEMKQEIGSRSSLESNGKGAEKNKGLVEGKVHGDNWQMQRTESGYESSDHISNGSTNLDSPVIDGNGTVMDISGVKETVCFSDQITTSNLNKERGDCTSLQSQHHLEGFRKELRNLEAGYKSHEFHPESHLQIKNHLIKRSHVHEDNGKLFPSSSLQIPKDHNAREHIHQSDEQKLEKPNECKFSEWLNIENSERTGLPFHVDNSASGKRVNSNEPSSLWSSHLRTVGLKPETAPLIQQQNIMDQCYFENSLSTECIIRSASRSDGCQMPKLFCQNLPPPLPPKKYAITSVPQSEKSESTPDVKLTEVFKATSHLPKHSLSTASEPSLEVSTHMNDERHKETFQVRECFGNTPNCPSSSSTNDFQANSGAIDAFCQPELDSISTCPNETVSLTTYFSVDSCMTDTYRLKYHQRPKLSFPESSGFCNNSLS

SEQ ID NO: 16798 - protein, 1073 aa, Homo sapiens; identical to SEQ ID NO: 16797

SEQ ID NO: 16799 - protein, 744 aa, Homo sapiens
MSWKRNYFSGGRGSVQGMFAPRSSTSIAPSKGLSNEPGQNSCFLNSALQVLWHLDIFRRSFRQLTTHKCMGDSCIFCALKGIFNQFQCSSEKVLPSDTLRSALAKTFQDEQRFQLGIMDDAAECFENLLMRIHFHIADETKEDICTAQHCISHQKFAMTLFEQCVCTSCGATSDPLPFIQMVHYISTTSLCNQAICMLERREKPSPSMFGELLQNASTMGDLRNCPSNCGERIRIRRVLMNAPQIITIGLVWDSDHSDLAEDVIHSLGTCLKLGDLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGREPSISSDTRTDSSTESYPYKHSHHESVVSHFSSDSQGTVIYNVENDSMSQSSRDTGHLTDSECNQKHTSKKGSLIERKRSSGRVRRKGDEPQASGYHSEGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRYCLAFEQQHCLLQQCEPPTWGFQAWLRQVEGWPLLLSLCALSTSYNNSTLCWKNRGT

SEQ ID NO: 16800 - protein, 1684 aa, Homo sapiens
MSWKRNYFSGGRGSVQGMFAPRSSTSIAPSKGLSNEPGQNSCFLNSALQVLWHLDIFRRSFRQLTTHKCMGDSCIFCALKGIFNQFQCSSEKVLPSDTLRSALAKTFQDEQRFQLGIMDDAAECFENLLMRIHFHIADETKEDICTAQHCISHQKFAMTLFEQCVCTSCGATSDPLPFIQMVHYISTTSLCNQAICMLERREKPSPSMFGELLQNASTMGDLRNCPSNCGERIRIRRVLMNAPQIITIGLVWDSDHSDLAEDVIHSLGTCLKLGDLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGREPSISSDTRTDSSTESYPYKHSHHESVVSHFSSDSQGTVIYNVENDSMSQSSRDTGHLTDSECNQKHTSKKGSLIERKRSSGRVRRKGDEPQASGYHSEGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGEEISSKSELDELQEEVARRAQEQELRRKREKELEAAKGFNPHPSRFMDLDELQNQGRSDGFERSLQEAESVFEESLHLEQKGDCAAALALCNEAISKLRLALHGASCSTHSRALVDKKLQISIRKARSLQDRMQQQQSPQQPSQPSACLPTQAGTLSQPTSEQPIPLQVLLSQEAQLESGMDTEFGASSFFHSPASCHESHSSLSPESSAPQHSSPSRSALKLLTSVEVDNIEPSAFHRQGLPKAPGWTEKNSHHSWEPLDAPEGKLQGSRCDNSSCSKLPPQEGRGIAQEQLFQEKKDPANPSPVMPGIATSERGDEHSLGCSPSNSSAQPSLPLYRTCHPIMPVASSFVLHCPDPVQKTNQCLQGQSLKTSLTLKVDRGSEETYRPEFPSTKGLVRSLAEQFQRMQGVSMRDSTGFKDRSLSGSLRKNSSPSDSKPPFSQGQEKGHWPWAKQQSSLEGGDRPLSWEESTEHSSLALNSGLPNGETSSGGQPRLAEPDIYQEKLSQVRDVRSKDLGSSTDLGTSLPLDSWVNITRFCDSQLKHGAPRPGMKSSPHDSHTCVTYPERNHILLHPHWNQDTEQETSELESLYQASLQASQAGCSGWGQQDTAWHPLSQTGSADGMGRRLHSAHDPGLSKTSTAEMEHGLHEARTVRTSQATPCRGLSRECGEDEQYSAENLRRISRSLSGTVVSEREEAPVSSHSFDSSNVRKPLETGHRCSSSSSLPVIHDPSVFLLGPQLYLPQPQFLSPDVLMPTMAGEPNRLPGTSRSVQQFLAMCDRGETSQGAKYTGRTLNYQSLPHRSRTDNSWAPWSETNQHIGTRFLTTPGCNPQLTYTATLPERSKGLQVPHTQSWSDLFHSPSHPPIVHPVYPPSSSLHVPLRSAWNSDPVPGSRTPGPRRVDMPPDDDWRQSSYASHSGHRRTVGEGFLFVLSDAPRREQIRARVLQHSQW

SEQ ID NO: 16801 - protein, 725 aa, Homo sapiens
MDTEFGASSFFHSPASCHESHSSLSPESSAPQHSSPSRSALKLLTSVEVDNIEPSAFHRQGLPKAPGWTEKNSHHSWEPLDAPEGKLQGSRCDNSSCSKLPPQEGRGIAQEQLFQEKKDPANPSPVMPGIATSERGDEHSLGCSPSNSSAQPSLPLYRTCHPIMPVASSFVLHCPDPVQKTNQCLQGQSLKTSLTLKVDRGSEETYRPEFPSTKGLVRSLAEQFQRMQGVSMRDSTGFKDRSLSGSLRKNSSPSDSKPPFSQGQEKGHWPWAKQQSSLEGGDRPLSWEESTEHSSLALNSGLPNGETSSGGQPRLAEPDIYQEKLSQVRDVRSKDLGSSTDLGTSLPLDSWVNITRFCDSQLKHGAPRPGMKSSPHDSHTCVTYPERNHILLHPHWNQDTEQETSELESLYQASLQASQAGCSGWGQQDTAWHPLSQTGSADGMGRRLHSAHDPGLSKTSTAEMEHGLHEARTVRTSQDSSNVRKPLETGHRCSSSSSLPVIHDPSVFLLGPQLYLPQPQFLSPDVLMPTMAGEPNRLPGTSRSVQQFLAMCDRGETSQGAKYTGRTLNYQSLPHRSRTDNSWAPWSETNQHIGTRFLTTPGCNPQLTYTATLPERSKGLQVPHTQSWSDLFHSPSHPPIVHPVYPPSSSLHVPLRSAWNSDPVPGSRTPGPRRVDMPPDDDWRQSSYASHSGHRRTVGEGFLFVLSDAPRREQIRARVLQHSQW

SEQ ID NO: 16802 - protein, 1684 aa, Homo sapiens; identical to SEQ ID NO: 16800

SEQ ID NO: 16803 - protein, 153 aa, Homo sapiens
MSWKRNYFSGGRGSVQGMFAPRSSTSIAPSKGLSNEPGQNSCFLNSALQVLWHLDIFRRSFRQLTTHKCMGDSCIFCALKGIFNQFQCSSEKVLPSDTLRSALAKTFQDEQRFQLGIMDDAAECFENLLMRIHFHIADETKEDICTAQHCISH

SEQ ID NO: 16804 - protein, 819 aa, Homo sapiens
MDLDELQNQAKLRLALHGASCSTHSRALVDKKLQISIRKARSLQDRMQQQQSPQQPSQPSACLPTQAGTLSQPTSEQPIPLQVLLSQEAQLESGMDTEFGASSFFHSPASCHESHSSLSPESSAPQHSSPSRSALKLLTSVEVDNIEPSAFHRQGLPKAPGWTEKNSHHSWEPLDAPEGKLQGSRCDNSSCSKLPPQEGRGIAQEQLFQEKKDPANPSPVMPGIATSERGDEHSLGCSPSNSSAQPSLPLYRTCHPIMPVASSFVLHCPDPVQKTNQCLQGQSLKTSLTLKVDRGSEETYRPEFPSTKGLVRSLAEQFQRMQGVSMRDSTGFKDRSLSGSLRKNSSPSDSKPPFSQGQEKGHWPWAKQQSSLEGGDRPLSWEESTEHSSLALNSGLPNGETSSGGQPRLAEPDIYQEKLSQVRDVRSKDLGSSTDLGTSLPLDSWVNITRFCDSQLKHGAPRPGMKSSPHDSHTCVTYPERNHILLHPHWNQDTEQETSELESLYQASLQASQAGCSGWGQQDTAWHPLSQTGSADGMGRRLHSAHDPGLSKTSTAEMEHGLHEARTVRTSQDSSNVRKPLETGHRCSSSSSLPVIHDPSVFLLGPQLYLPQPQFLSPDVLMPTMAGEPNRLPGTSRSVQQFLAMCDRGETSQGAKYTGRTLNYQSLPHRSRTDNSWAPWSETNQHIGTRFLTTPGCNPQLTYTATLPERSKGLQVPHTQSWSDLFHSPSHPPIVHPVYPPSSSLHVPLRSAWNSDPVPGSRTPGPRRVDMPPDDDWRQSSYASHSGHRRTVGEGFLFVLSDAPRREQIRARVLQHSQW

SEQ ID NO: 16805 - protein, 1534 aa, Homo sapiens
MSWKRNYFSGGRGSVQGMFAPRSSTSIAPSKGLSNEPGQNSCFLNSALQVLWHLDIFRRSFRQLTTHKCMGDSCIFCALKGIFNQFQCSSEKVLPSDTLRSALAKTFQDEQRFQLGIMDDAAECFLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGREPSISSDTRTDSSTESYPYKHSHHESVVSHFSSDSQGTVIYNVENDSMSQSSRDTGHLTDSECNQKHTSKKGSLIERKRSSGRVRRKGDEPQASGYHSEGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGEEISSKSELDELQEEVARRAQEQELRRKREKELEAAKGFNPHPSRFMDLDELQNQGRSDGFERSLQEAESVFEESLHLEQKGDCAAALALCNEAISKLRLALHGASCSTHSRALVDKKLQISIRKARSLQDRMQQQQSPQQPSQPSACLPTQAGTLSQPTSEQPIPLQVLLSQEAQLESGMDTEFGASSFFHSPASCHESHSSLSPESSAPQHSSPSRSALKLLTSVEVDNIEPSAFHRQGLPKAPGWTEKNSHHSWEPLDAPEGKLQGSRCDNSSCSKLPPQEGRGIAQEQLFQEKKDPANPSPVMPGIATSERGDEHSLGCSPSNSSAQPSLPLYRTCHPIMPVASSFVLHCPDPVQKTNQCLQGQSLKTSLTLKVDRGSEETYRPEFPSTKGLVRSLAEQFQRMQGVSMRDSTGFKDRSLSGSLRKNSSPSDSKPPFSQGQEKGHWPWAKQQSSLEGGDRPLSWEESTEHSSLALNSGLPNGETSSGGQPRLAEPDIYQEKLSQVRDVRSKDLGSSTDLGTSLPLDSWVNITRFCDSQLKHGAPRPGMKSSPHDSHTCVTYPERNHILLHPHWNQDTEQETSELESLYQASLQASQAGCSGWGQQDTAWHPLSQTGSADGMGRRLHSAHDPGLSKTSTAEMEHGLHEARTVRTSQATPCRGLSRECGEDEQYSAENLRRISRSLSGTVVSEREEAPVSSHSFDSSNVRKPLETGHRCSSSSSLPVIHDPSVFLLGPQLYLPQPQFLSPDVLMPTMAGEPNRLPGTSRSVQQFLAMCDRGETSQGAKYTGRTLNYQSLPHRSRTDNSWAPWSETNQHIGTRFLTTPGCNPQLTYTATLPERSKGLQVPHTQSWSDLFHSPSHPPIVHPVYPPSSSLHVPLRSAWNSDPVPGSRTPGPRRVDMPPDDDWRQSSYASHSGHRRTVGEGFLFVLSDAPRREQIRARVLQHSQW

SEQ ID NO: 16806 - protein, 80 aa, Homo sapiens
MSWKRNYFSGGRGSVQGMFAPRSSTSIAPSKGLSNEPGQNSCFLNSALQVLWHLDIFRRSFRQLTTHKCMGDSCIFCALK

SEQ ID NO: 16807 - protein, 1092 aa, Homo sapiens
MMDSPKIGNGLPVIGPGTDIGISSLHMVGYLGKNFDSAKVPSDEYCPACREKGKLKALKTYRISFQESIFLCEDLQCIYPLGSKSLNNLISPDLEECHTPHKPQKRKSLESSYKDSLLLANSKKTRNYIAIDGGKVLNSKHNGEVYDETSSNLPDSSGQQNPIRTADSLERNEILEADTVDMATTKDPATVDVSGTGRPSPQNEGCTSKLEMPLESKCTSFPQALCVQWKNAYALCWLDCILSALVHSEELKNTVTGLCSKEESIFWRLLTKYNQANTLLYTSQLSGVKDGDCKKLTSEIFAEIETCLNEVRDEIFISLQPQLRCTLGDMESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 16808 - protein, 118 aa, Homo sapiens
MFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 16809 - protein, 147 aa, Homo sapiens
MALKRIHKELNDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 16810 - protein, 147 aa, Homo sapiens; identical to SEQ ID NO: 16809

SEQ ID NO: 16811 - protein, 118 aa, Homo sapiens; identical to SEQ ID NO: 16808

SEQ ID NO: 16812 - protein, 147 aa, Homo sapiens
MALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAM

SEQ ID NO: 16813 - protein, 109 aa, Homo sapiens
MTNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAM

SEQ ID NO: 16814 - protein, 185 aa, Homo sapiens
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 16815 - protein, 153 aa, Homo sapiens
MLTLASKLKRDDGLKGSRTAATASDSTRRVSVRDKLLVKDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 16816 - protein, 171 aa, Homo sapiens
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKED

SEQ ID NO: 16817 - protein, 170 aa, Homo sapiens
MTELQSALLLRRQLAELNKNPVEGFSAGLIDDNDLYRWEVLIIGPPDTLYEGGVFKAHLTFPKDYPLRPPKMKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 16818 - protein, 183 aa, Homo sapiens
MIKLFSLKQQKKEEESAGGTKGSSKKASAAQLRIQKDINELNLPKTCDISFSDPDDLLNFKLVICPDEGFYKSGKFVFSFKVGQGYPHDPPKVKCETMVYHPNIDLEGNVCLNILREDWKPVLTINSIIYGLQYLFLEPNPEDPLNKEAAEVLQNNRRLFEQNVQRSMRGGYIGSTYFERCLK

SEQ ID NO: 16819 - protein, 1292 aa, Homo sapiens
MADPAAPTPAAPAPAQAPAPAPEAVPAPAAAPVPAPAPASDSASGPSSDSGPEAGSQRLLFSHDLVSGRYRGSVHFGLVRLIHGEDSDSEGEEEGRGSSGCSEAGGAGHEEGRASPLRRGYVRVQWYPEGVKQHVKETKLKLEDRSVVPRDVVRHMRSTDSQCGTVIDVNIDCAVKLIGTNCIIYPVNSKDLQHIWPFMYGDYIAYDCWLGKVYDLKNQIILKLSNGARCSMNTEDGAKLYDVCPHVSDSGLFFDDSYGFYPGQVLIGPAKIFSSVQWLSGVKPVLSTKSKFRVVVEEVQVVELKVTWITKSFCPGGTDSVSPPPSVITQENLGRVKRLGCFDHAQRQLGERCLYVFPAKVEPAKIAWECPEKNCAQGEGSMAKKVKRLLKKQVVRIMSCSPDTQCSRDHSMEDPDKKGESKTKSEAESASPEETPDGSASPVEMQDEGAEEPHEAGEQLPPFLLKEGRDDRLHSAEQDADDEAADDTDDTSSVTSSASSTTSSQSGSGTSRKKSIPLSIKNLKRKHKRKKNKITRDFKPGDRVAVEVVTTMTSADVMWQDGSVECNIRSNDLFPVHHLDNNEFCPGDFVVDKRVQSCPDPAVYGVVQSGDHIGRTCMVKWFKLRPSGDDVELIGEEEDVSVYDIADHPDFRFRTTDIVIRIGNTEDGAPHKEDEPSVGQVARVDVSSKVEVVWADNSKTIILPQHLYNIESEIEESDYDSVEGSTSGASSDEWEDDSDSWETDNGLVEDEHPKIEEPPIPPLEQPVAPEDKGVVISEEAATAAVQGAVAMAAPMAGLMEKAGKDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPSNHSFKKIEFQPPEAKKFFSTVRKEMALLATSLPEGIMVKTFEDRMDLFSALIKGPTRTPYEDGLYLFDIQLPNIYPAVPPHFCYLSQCSGRLNPNLYDNGKVCVSLLGTWIGKGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQGLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 16820 - protein, 422 aa, Homo sapiens
MQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 16821 - protein, 161 aa, Homo sapiens
MKELQDIARLSDRFISVELVDESLFDWNVKLHQVDKDSVLWQDMKETNTEFILLNLTFPDNFPFSPPFMRVLSPRLENGYVLDGGAICMELLTPRGWSSAYTVEAVMRQFAASLVKGQGRICRKAGKSKKSFSRKEAEATFKSLVKTHEKYGWVTPPVSDG

SEQ ID NO: 16822 - protein, 226 aa, Homo sapiens
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLK

SEQ ID NO: 16823 - protein, 321 aa, Homo sapiens
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLKYSVIKCWLARKRMPHEVTHSMEEIKLCPTLIPTTDEIFLESPTAINSITDIYETEEEGWKSDTSLYENDTDEPREEEVEDLISWTNTLNTNTSED

SEQ ID NO: 16824 - protein, 167 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDHFKPLWARNVPKFGLAHLMALGLGPWLAVEIPDLIQKGVIQHKEKCNQ

SEQ ID NO: 16825 - protein, 1058 aa, Homo sapiens
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 16826 - protein, 506 aa, Homo sapiens
MGFHHVGQAGLEPLTSGDPSALASQSAGITGVSYCAWPGFSIEVGEWGRLEGFPTSRVAVRLVLALFTDGPSNNACGNPFCQLWPHVICLLCLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 16827 - protein, 1058 aa, Homo sapiens; identical to SEQ ID NO: 16825

SEQ ID NO: 16828 - protein, 271 aa, Homo sapiens
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLG

SEQ ID NO: 16829 - protein, 173 aa, Homo sapiens
MLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGF

SEQ ID NO: 16830 - protein, 284 aa, Homo sapiens
MLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVL

SEQ ID NO: 16831 - protein, 234 aa, Homo sapiens
MSKPHFPPALPAPAAIPGIKGEENGCLLLPTYSVPGSMLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRG

SEQ ID NO: 16832 - protein, 195 aa, Homo sapiens
MSKPHFPPALPAPAAIPGIKGEENGCLLLPTYSVPGSMLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPV

SEQ ID NO: 16833 - protein, 280 aa, Homo sapiens
MATEAPVNIAPPECSTVVSTAVDSLIWQPNSLNMHMIRPKSAKGRTRPSLQKSQGVEVCAHHIPSPPPAIPYELPSSQKPGACAPKSPNQGASDEIPELQQQVPTGASSSLNKYPVLPSINRKNLEEEAVETVAKKASSLQLSSIRALYQDETGTMKTSEEDSRARACAVERKFIVRTKKQGSSRAGNLEEPSDQEPRLLLAVRSPTGQRFVRHFRPTDDLQTIVAVAEQKNKTSYRHCSIETMEVPRRRFSDLTKSLQECRIPHKSVLGISLEDGEGWP

SEQ ID NO: 16834 - protein, 384 aa, Homo sapiens
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLLAVKSAPEHYERRELIRRTWGQERSYGGRPVRRLFLLGTPGPEDEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGPTARALRAAARHTPLFPIDDAYMGMCLERAGLAPSGHEGIWPFGVQLPGAQQSSFDPCMYRELLLVHRFAPYEMLLMWKALHSPALSCDRGHRVS

SEQ ID NO: 16835 - protein, 263 aa, Homo sapiens
MAFPCRRSLTAKTLACLLVGVSFLALQQRRRQRVPPTLPRPARAHPGLPAVPQERSYGGRPVRRLFLLGTPGPEDEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGLAPSGHEGIPSACSLPGAQQSSFDPCMYRELLLVHRFAPYEMLLMWKALHSPALSCDRGHRVS

SEQ ID NO: 16836 - protein, 121 aa, Homo sapiens
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLL

SEQ ID NO: 16837 - protein, 385 aa, Homo sapiens
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLLAVKSAPEHYERRELIRRTWGQERSYGGRPVRRLFLLGTPGPEDEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGPTARALRAAARHTPLFPIDDAYMGMCLGARRPGAQRPRGHPGPSACSLPGAQQSSFDPCMYRELLLVHRFAPYEMLLMWKALHSPALSCDRGHRVS

SEQ ID NO: 16838 - protein, 361 aa, Homo sapiens
MSGAGVGGASEESQAMQAHVSIILPVHNAEPWLDECLRSVLQQDFEGTMELSVFNDASKDKSGAIIEKWRVKLEDSGVHVIIGGHDSPSPRGVGYAKNQAVAQSSGSYLCFLDSDDVMMPQRVRLQHEAAVQHPSSIIGCRVRRDPPNSTERYTRWINQLTPEQLLTQVFTSNGPTVIMPTWFCSRAWFSHVGPFNEGGQGVPEDLLFFYEHLRKGGGVIRVDQSLLLYRHHPQAATHCVLETTIWTHRVRFLEEQALPRWAAFTIWNAGKQGRRLYRSLTAGSQRKVVAFCDVDENKIRKGFYCHEDSQERPKPRIPILHFRAARPPFVICVKLDLTGGAFEDNLRSLHLQEGQDFLHFS

SEQ ID NO: 16839 - protein, 603 aa, Homo sapiens
MAVARKIRTLLTVNILVFVGIVLFSVYCRLQGRSQELVRIVSGDRRVRSRHAKVGTLGDREAILQRLDHLEEVVYNQLNGLAKPIGLVEGPGGLGQGGLAATLRDDGQEAEGKYEEYGYNAQLSDRISLDRSIPDYRPRKCRQMSYAQDLPQVSVVFIFVNEALSVILRSVHSVVNHTPSQLLKEVILVDDNSDNVELKFNLDQYVNKRYPGLVKIVRNSRREGLIRARLQGWKAATAPVVGFFDAHVEFNTGWAEPALSRIREDRRRIVLPAIDNIKYSTFEVQQYANAAHGYNWGLWCMYIIPPQDWLDRGDESAPIRTPAMIGCSFVVDREYFGDIGLLDPGMEVYGGENVELGMRVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 16840 - protein, 237 aa, Homo sapiens
MEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 16841 - protein, 354 aa, Homo sapiens
MIGCSFVVDREYFGDIGLLDPGMEVYGGENVELGMRETEGFQQDKVNYKQNKRGRKTRQRVKRSRSEAHRAQPSPGATHGAHSRAPGPRTEPTAEPWGHARPTAALPATGVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 16842 - protein, 97 aa, Homo sapiens
MEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTL

SEQ ID NO: 16843 - protein, 237 aa, Homo sapiens; identical to SEQ ID NO: 16840

SEQ ID NO: 16844 - protein, 54 aa, Homo sapiens
MEVLPCSRVAHIERTRKPYNNDIDYYAKRNALRAAEVWMDDFKSHVYMAWNIPM

SEQ ID NO: 16845 - protein, 237 aa, Homo sapiens; identical to SEQ ID NO: 16840

SEQ ID NO: 16846 - protein, 603 aa, Homo sapiens; identical to SEQ ID NO: 16839

SEQ ID NO: 16847 - protein, 384 aa, Homo sapiens
MGPGPSPNWTLDPEPRCRLWSEPRLPAGPGVLAAGSPRLPCRYVMTSEFTLGPTAEFFREHNFFHLDPANVVMFEQRLLPAVTFDGKVILERKDKVAMAPDGNGGLYCALEDHKILEDMERRGVEFVHVYCVDNILVRLADPVFIGFCVLQGADCGAKVVEKAYPEEPVGVVCQVDGVPQVVEYSEISPETAQLRASDGSLLYNAGNICNHFFTRGFLKAVTREFEPLLKPHVAVKKVPYVDEEGNLVKPLKPNGIKMEKFVFDVFRFAKNFAALEVLREEEFSPLKNAEPADRDSPRTARQALLTQHYRWALRAGARFLDAHGAWLPELPSLPPNGDPPAICEISPLVSYSGEGLEVYLQGREFQSPLILDEDQAREPQLQES

SEQ ID NO: 16848 - protein, 507 aa, Homo sapiens
MASEQDVRARLQRAGQEHLLRFWAELAPEPRAALLAELALLEPEALREHCRRAAEACARPHGPPPDLAARLRPLPPERVGRASRSDPETRRRWEEEGFRQISLNKVAVLLLAGGQGTRLGVTYPKGMYRVGLPSRKTLYQLQAERIRRVEQLAGERHGTRCTVPWYVMTSEFTLGPTAEFFREHNFFHLDPANVVMFEQRLLPAVTFDGKVILERKDKVAMAPDGNGGLYCALEDHKILEDMERRGVEFVHVYCVDNILVRLADPVFIGFCVLQGADCGAKVVEKAYPEEPVGVVCQVDGVPQVVEYSEISPETAQLRASDGSLLYNAGNICNHFFTRGFLKAVTREFEPLLKPHVAVKKVPYVDEEGNLVKPLKPNGIKMEKFVFDVFRFAKNFAALEVLREEEFSPLKNAEPADRDSPRTARQALLTQHYRWALRAGARFLDAHGAWLPELPSLPPNGDPPAICEISPLVSYSGEGLEVYLQGREFQSPLILDEDQAREPQLQES

SEQ ID NO: 16849 - protein, 1440 aa, Homo sapiens
MAGIIKKQILKHLSRFTKNLSPDKINLSTLKGEGQLTNLELDEEVLQNVLELPTWLAITRVYCNRASIRIQWTKLKTHPICLCLDKVEVEMKTCEDPRPPNGQSPIALASGQSEYGFAEKVVEGMFIIVNSITIKIHSKAFHASFELWQLQGYSVNPNWQQSDLRLTRITDPCRGEVLTFKEITWQTLRIEADATDNGDQDPVTTPLRLITNQGRIQIALKRRTKDCNVISSKLMFLLDDLLWVLTDSQLKAMMKYAESLSEAMEKSAHQRKSLAPEPVQITPPAPSAQQSWAQAFGGSQGNSNSSSSRLSQYFEKFDVKESSYHLLISRLDLHICDDSQSREPGVSANRLMGGAMQLTFRKMAFDYYPFHWAGDSCKHWVRHCEAMETRGQWAQKLVMEFQSKMEKWHEETGLKPPWHLGVDSLFRRKADSLSSPRKNPLERSPSQGRQPAFQPPAWNRLRSSCMVVRVDDLDIHQVSTAGQPSKKPSTLLSCSRKLHNLPTQVSAIHIEFTEYYFPDNQELPVPCPNLYIQLNGLTFTMDPVSLLWGNLFCLDLYRSLEQFKAIYKLEDSSQKDEHLDIRLDAFWLKVSFPLEKRERAELHRPQALVFSASGMIATNTRHAPHCSCSDLQSLFRGFAAAEFFHSNYDHFPKVPGGFSLLHMLFLHHAFQMDSCLPQPNTLPPQRPKASWDLWSVHFTQISLDFEGTENFKGHTLNFVAPFPLSIWACLPLRWQQAQARKLLLASEGRLKPSASFGSPVQSEALAPDSMSHPRSKTEHDLKSLSGLTEVMEILKEGSSGMDNKGPLTELEDVADVHMLVHSPAHVRVRLDHYQYLALLRLKEVLQRLQEQLTKDTESMTGSPLQNQTACIGVLFPSAEVALLMHPAPGAVDADSAGSDSTSLVDSELSPSEDRELKSDASSDQGPASPEKVLEESSIENQDVSQERPHSNGELQDSGPLAQQLAGKGHEAVESLQAKKLSRTQASSSPAALKPPAGRETAVNGQGELIPLKNIEGELSSAIHMTKDATKEALHATMDLTKEAVSLTKDAFSLGRDRMTSTMHKMLSLPPAKEPMAKTDEGVAAPVSGGAARLRFFSMKRTVSQQSFDGVSLDSSGPEDRISVDSDGSDSFVMLLESESGPESVPPGSLSNVSDNAGVQGSPLVNNYGQGSPAANSSVSPSGEDLIFHPVSVLVLKVNEVSFGIEVRGEDLTVALQAEELTLQQLGTVGLWQFLHGQCPGTCFQESSTLKTGHIRPAVGLRFEVGPGAAVHSPLASQNGFLHLLLHGCDLELLTSVLSGLGPFLEDEEIPVVVPMQIELLNSSITLKDDIPPIYPTSPGPIPITLAMEHVVLKRSDDGVFHIGAAAQDKPSAEVLKSEKRQPPKEQVFLVPTGEVFEQQVKELPILQKELIETKQALANANQDKEKLLQEIRKYNPFFEL

SEQ ID NO: 16850 - protein, 1400 aa, Homo sapiens
MAGIIKKQILKHLSRFTKNLSPDKINLSTLKGEGQLTNLELDEEVLQNVLELPTWLAITRVYCNRASIRIQWTKLKTHPICLCLDKVEVEMKTCEDPRPPNGQSPIALASGQSEYGFAEKVVEGMFIIVNSITIKIHSKAFHASFELWQLQGYSVNPNWQQSDLRLTRITDPCRGEVLTFKEITWQTLRIEADATDNGDQDPVTTPLRLITNQGRIQIALKRRTKDCNVISSKLMFLLDDLLWVLTDSQLKAMMKYAESLSEAMEKSAHQRKSLAPEPVQITPPAPSAQQSWAQAFGGSQGNSNSSSSRLSQYFEKFDVKESSYHLLISRLDLHICDDSQSREPGVSANRLMGGAMQLTFRKMAFDYYPFHWAGDSCKHWVRHCEAMETRGQWAQKLVMEFQSKMEKWHEETGLKPPWHLGVDSLFRRKADSLSSPRKNPLERSPSQGRQPAFQPPAWNRLRSSCMVVRVDDLDIHQVSTAGQPSKKPSTLLSCSRKLHNLPTQVSAIHIEFTEYYFPDNQELPVPCPNLYIQLNGLTFTMDPVSLLWGNLFCLDLYRSLEQFKAIYKLEDSSQKDEHLDIRLDAFWLKVSFPLEKRERAELHRPQALVFSASGMIATNTRHAPHCSCSDLQSLFRGFAAAEFFHSNYDHFPKVPGGFSLLHMLFLHHAFQMDSCLPQPNTLPPQRPKASWDLWSVHFTQISLDFEGTENFKGHTLNFVAPFPLSIWACLPLRWQQAQARKLLLASEGRLKPSASFGSPVQSEALAPDSMSHPRSKTEHDLKSLSGLTEVMEILKEGSSGMDNKGPLTELEDVADVHMLVHSPAHVRVRLDHYQYLALLRLKEVLQRLQEQLTKDTESMTGSPLQNQTACIGVLFPSAEVALLMHPAPGAVDADSAGSDSTSLVDSELSPSEDRELKSDASSDQGPASPEKVLEESSIENQDVSQERPHSNGELQDSGPLAQQLAGKGHEAVESLQAKKLSRTQASSSPAALKPPAGRETAVNGQGELIPLKNIEGELSSAIHMTKDATKEALHATMDLTKEAVSLTKDAFSLGRDRMTSTMHKMLSLPPAKEPMAKTDEGVAAPVSGGAARLRFFSMKRTVSQQSFDGVSLDSSGPEDRISVDSDGSDSFVMLLESESGPESVPPGSLSNVSDNAGVQGSPLVNNYGQGSPAANSSVSPSGEDLIFHPVSVLVLKVNEVSFGIEVRGEDLTVALQAEELTLQQLGTVGLWQFLHGQCPGTCFQESSTLKTGHIRPAVGLRFEVGPGAAVHSPLASQNGFLHLLLHGCDLELLTSVLSGLGPFLEDEEIPVVVPMQIELLNSSITLKDDIPPIYPTSPGPIPITLAMEHVVLKRSDDGVFHIGAAAQDKPSAEVLKSEKRQPPKEQVFLVPTGEVFEQQT

SEQ ID NO: 16851 - protein, 1464 aa, Homo sapiens
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPIPSPNLYSQLNALQFTVDERSILWLNQFLLDLKQSLNQFMAVYKLNDNSKSDEHVDVRVDGLMLKFVIPSEVKSECHQDQPRAISIQSSEMIATNTRHCPNCRHSDLEALFQDFKDCDFFSKTYTSFPKSCDNFNLLHPIFQRHAHEQDTKMHEIYKGNITPQLNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLMEENESLKQELAKAKMALAEAHLEKDALLHHIKKMTVE

SEQ ID NO: 16852 - protein, 522 aa, Homo sapiens
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPTAFLSR

SEQ ID NO: 16853 - protein, 251 aa, Homo sapiens
MSGSNPKAAAAASAAGPGGLVAGKEEKKKAGGGVLNRLKARRQAPHHAADDGVGAAVTEQELLALDTIRPEHVLRLSRVTENYLCKPEDNIYSIDFTRFKIRDLETGTVLFEIAKPCVSDQEEDEEEGGGDVDISAGRFVRYQFTPAFLRLRTVGATVEFTVGDKPVSNFRMIERHYFREHLLKNFDFDFGFCIPSSRNTCEHIYEFPQLSEDVIRLMIENPYETRSDSFYFVDNKLIMHNKADYAYNGGQ

SEQ ID NO: 16854 - protein, 251 aa, Homo sapiens; identical to SEQ ID NO: 16853

SEQ ID NO: 16855 - protein, 1275 aa, Homo sapiens
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVEAIVLLTELIRENFRNSKLKQCLLPTLGELIYLVATQEEKKKNPRECWAVPLAAYTVLMRCLREGEERVVNHMAAKIIENVCTTFSAQSQGFITGEIGPILWYLFRHSTADSLRITAVSALCRITRHSPTAFQNVIEKVGLNSVINSLASAICKVQQYMLTLFAAMLSCGIHLQRLIQEKGFVSTIIRLLDSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRLVEESKLIPLIFEVTLEHQESILGNTMQSVIALLSNLVACKDSNMELLYEQGLVSHICNLLTETATLCLDVDNKNNNEMAAPLLFSLLDILHSMLTYTSGIVRLALQAQKSGSGEDPQAAEDLLLLNRPLTDLISLLIPLLPNEDPEIFDVSSKCLSILVQLYGGENPDSLSPENVEIFAHLLTSKEDPKEQKLLLRILRRMITSNEKHLESLKNAGSLLRALERLAPGSGSFADSAVAPLALEILQAVGH

SEQ ID NO: 16856 - protein, 69 aa, Homo sapiens
MQKYCIYQHFQFQLLIQHLWIAANCDIWAKVARVIGLLASHKTDLQENTPVVEAFPNSPRTPTLPGVLT

SEQ ID NO: 16857 - protein, 69 aa, Homo sapiens; identical to SEQ ID NO: 16856

SEQ ID NO: 16858 - protein, 2458 aa, Homo sapiens
MISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIRQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 16859 - protein, 2635 aa, Homo sapiens
MSTKAEQFASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIRQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 16860 - protein, 2657 aa, Homo sapiens
MNSKRHKIASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIPMRLTRHEQSAPALGGTPEQTPGQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 16861 - protein, 2657 aa, Homo sapiens
MSTKAEQFASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIPMRLTRHEQSAPALGGTPEQTPGQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 16862 - protein, 132 aa, Homo sapiens
MREGQEMGPTPVPSNPLLHRSFPCWPRGWSHPVPTRELLLEPAQPADLLPPAPTAGPCSLASWMLSQPGRGSQVKTGGTPTATAQDAEAPLPDCDLCLSPAPVGTWQPRAKAGWAGDPRNLSGNTFSPGWEQ

SEQ ID NO: 16863 - protein, 600 aa, Homo sapiens
MFTLSLLSRGHGKLGQDKQKLEVYFEPEDYLNWRSPEDYVPVSKPQDKNNASQHSWSLFLPKTFSTRKGALILYSEGFAISAWTPKERRKGPYCPRGPWRKLDLELHTLQDLKEAILAYGRQQLNLPMGDAGKRLEREKKRKTTVFLPSHSASSEKKHLHYLCDTALNRQAHYDPQLLQGEQDRAWQPYLHFRSQLESQAQRQIQPGHSAKRYLRGLLRTWPPDAMYRLWCAGYIKDSVLLQDSQLNVPKKLRPQQDLSGVPPKYHLLPVFPSFWIQQGKSFEQRQQGLDEGEAGAAGHVDQGPLAKNHGSQGTRLPPRRKQPWQEDETQAEDTSIENHLCLYASKESYNEKTQQTSRKAFGHGRIDHSWLPSDKSHITFCGGAFPNRKADLSDKQRNVKLHKARSSHLLQVLPAERSLFPPVASATGSRIITPGEVKKKKAPKALKLPPISEEPPRVLEPLKSQFKANEPPTELFILPVEIHYHTKQPPKEKAHRRGAPHPESEPESSEESTPVWRPPLKHASLETPWELTVHLPVDASRDTLSPQGSSSLPPASLGNLTLKGSKARHTRVHSQGKGVWKGDDDAPPHDVAPPLDLLPP

SEQ ID NO: 16864 - protein, 119 aa, Homo sapiens
MSGSPQASYPQTHSFTLKHQEIRTFWNLNMRGLGGEGGTEEESSLGQAGGKLKTAAWPSWVAEVGAAGALADPGGQKSGSFLPSQQLQCIPGPGLYAGEASKDPVLRKLPFQCGRTHNP

SEQ ID NO: 16865 - protein, 134 aa, Homo sapiens
MLVVGAGPLGAAAWSQRLDWGRCQLKLLGQHGQDVLHTNLGEENVCIAGPLLLPCPDSQPCLTPPHPAQALVQLWVPCPCLCPRVGASTAWLEGDTPALPQHLGPSITTTGRWATPKKIPGLTVPPENMDSMWG

SEQ ID NO: 16866 - protein, 148 aa, Homo sapiens
MDCVPPIQCSCSMGGRYHHPAGEAFWTGERCEQFCHCQASTHAVCCSPSSCGPGQRCETLRGIFGCHPLSPGIYQATMHSHVASFDRKSVEFPGTCASAFTKSCGSSSSLRLFKVEIGKEKQVQQSHCVHFKDVGSWDPGLSAERAPT

SEQ ID NO: 16867 - protein, 204 aa, Homo sapiens
MGPQHGTGPDPPPLCHCPHTAGGGAGGTGAPAFGLQGIWVPLAVGDRRGPCGQGASMGAPGQPRQGGRGKGQEASAQTRYGGNSPHGRGQNRLEGPGVQVCCNRARRARGCPHPGQRHHVVLSQWSGSGLVGGIEDTADLAPPPGAGLSPLAHSKGRDQRGGGLHPPSPRCSPPPYHPVQRCPRRWESCEGRPHLACSGCPASC

SEQ ID NO: 16868 - protein, 180 aa, Homo sapiens
MQRGPLSPSPSDGLGALGTTYPGVHRGQSMAGLRVPAFNAGLRAITPSRAETQHPETTSSGMHREPLSSTPIAHWEGAQSPGAQSVLAMLVHRTAAYTLQVLEPKKDPGRELPATPRSWAPARQPSPLHSIRQTMPAKPSLVKRERRNQALAREAPWFPQRTQWKTSEGPGSSSGRRGRR

SEQ ID NO: 16869 - protein, 151 aa, Homo sapiens
MPYETRSWITLLRTQRREECGLHCTSLPSLARDLKFHTTEPNTSRPSSNDLRNRKLCLAADKLSQCPWDLQDVWNEERQLSQCELSGGPQKNVGRRVFPIRQTVLQPRPPKRSNPGLLFSGTECGCILPFLCFLSRYLLTVHMRGLGKLSV

SEQ ID NO: 16870 - protein, 122 aa, Homo sapiens
MTWLDKGVWTQEDENSCSFSESDFPGCRDQINPSIPSIWTAVSGMMISLEVRWWIKGKQGYVISLGHALSPRLECSGTFSAHCILGLPGGSSYPPASVSQVVGTTALYLVEEAWAEAGKMRS

SEQ ID NO: 16871 - protein, 219 aa, Homo sapiens
MAARSVDDISIKLLHEKGPATDHGVNVLPSTVPGREEGMTDRKHWFSFGTQPNVPGLQEPLDYRAANQAWQAVLAEVPRGGPGCAALRDLGRCGGPDVSTRRQWRPLPFSCPLSHTTQPPLGGHCRGSSAGRFHGRDQTSPGTVQQLPSAHVLKPGCTQHGDLSPGQASPPPAAALGPSPKAWTHTLGRPQLWAGLGSHRFGVPGPGTRNTLAACCVQE

SEQ ID NO: 16872 - protein, 156 aa, Homo sapiens
MATPPAPGAGTAAPSAPRPPPPRPSWLRLDPAARGARLPFPGSPGTTRRAPRESAPLAPALRSDPGQPLAACNGPPGEPRADPGVSTRCAATMIPQGKLTGGRSCGSRPRMGRGERAELSFPAAAPRLKRGLGFWFFFCGNSSVEILLACHTTHPF

SEQ ID NO: 16873 - protein, 144 aa, Homo sapiens
MSLKSLFCNSEAKDNKCYHTYSESSWSETKKIVIATKIHSFQTFSSCYSDCHGILGVLLHQLETSVAGGTFCLSIAHAWWARFAHSSWKAALGSCYQPGFHTCQGQARLGSVRGVWASEHGVQPQRTGRHTGCCGRVGSFRHCS

SEQ ID NO: 16874 - protein, 249 aa, Homo sapiens
MRVRWLRFWLLFWLLLGFISHQPTPVINTLADHRHRETDFGGSPWIIIIIVFLGRYKFTILFCTIYLCVPFLKTIFWSRNGHDRSRDVQQRARRSNRRRQEGIKIGLEDICTLWKQAETKVQAKIRKMKVTKKVNHHYKINGKRKTAKEQKMFQRAQELRWRAEDYHKCKITPSARKPLCNWVSLFVFLAFGSLPGQDMDTFFSLQLCAQALQREMAERKAAYKHHSPIPVGNRVVQKHLHPHPVGPLI

SEQ ID NO: 16875 - protein, 133 aa, Homo sapiens
MACAIQLASSEARDRARPRDRTFLQKRQLGAGVWLLGERTSNTMLNWNGERGHPCLVLVFKRNIEADFKSSFSSEHFFFIPLDDCNCKEELAVISDGRTIVCYHHSVDISYEHTKQTLNQILCMIMKKHMFKC

SEQ ID NO: 16876 - protein, 616 aa, Homo sapiens
MPPLETQSSLAPPSLQTPPASLTTPPLENLPSLAPPPLQTASAPLTTPHLETPPCPAPCPLQAPPSPLTTPPPETPSSIATPPPQAPPALASPPLQGLPSPPLSPLATPPPQAPPALALPPLQAPPSPPASPPLSPLATPSPQAPNALAVHLLQAPFSPPPSPPVQAPFSPPASPPVSPSATPPSQAPPSLAAPPLQVPPSPPASPPMSPSATPPPQAPPPLAAPPLQVPPSPPASPPMSPSATPPPRVPPLLAAPPLQVPPSPPASLPMSPLAKPPPQAPPALATPPLQALPSPPASFPGQAPFSPSASLPMSPLATPPPQAPPVLAAPLLQVPPSPPASPTLQAPRRPPTPGPDTSVSGPRLTLALAPGPPPPPSRSPSSTLSGPDLAGHSSSATSTPEELRGYDSGPEGGAAASPPPDAELAACHPAAWSRGPAPPLAFRGAPGAPLPWPPATGPGSADGLCTIYETEGPESATPAPGALDPGPSPGTSGGKAAAGAGAGASSRSPKQARLGELPLGALQASVVQHLLSRTLLLAAAEGAAGGSGGGPGGAEGGGVTGGARAALSDAELGRWAELLSPLDESRASITSVTSFSPDDVASPQGDWTVVEVETFH

SEQ ID NO: 16877 - protein, 182 aa, Homo sapiens
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYM

SEQ ID NO: 16878 - protein, 407 aa, Homo sapiens
MYNAFWNHLKEQLLSTPPDFTCALELLKDVKENRLRNEIEEALDTDLLKQEAEHGALDVPHLSNYILNLMALLCAPVRDEAIQKLETIRDPVQLLRGILRVLGLMKMDMVNYTIQSFRPYLQEHSIQYEQAKFQELLDKQPSLLDYTTKWLTKAATDITTLCPSSPDSPSSSCSMACSLPSGAGNNSEPPSPTMVLYQGYLNLLLWDLENVEFPETLLMDRIRLQELAFQLHQLTVLASVLLVARSFSGEVLFRSPEFVDRLKCTTKALTEEFISRPEETMLSVSEQVSQEVHQGLKDMGLTTLSSENTASLLGQLQNITKKENCIRSIVDQWIRFFLKCCLLHGMQESLLHFPGGLILIEKELAELGWKFLNLMHHNQQVFGPYYAEILKHIIHPAQAQETDVEPN

SEQ ID NO: 16879 - protein, 143 aa, Homo sapiens
MLRKTCGGQQEDSRGMGPHLPRVPDGVVLGVEEPEGKAQGRVRGELCPGALARIHMGHSCTRLSAEGIAMLLGTAGPSRLPAAPDASQAPLRSPWALSVAAALCSPVSCHPCGRHVVTFGHCPAQGPWGLGTFGHSFFGCLCK

SEQ ID NO: 16880 - protein, 161 aa, Homo sapiens
MGHRPNLGQPPHPNAVAAALHASLCPANWGTCPLGKPGYPGCLWFQPLLLFPGCLCSPDGPFPRAVFTSAGKGPLQTDLGRGRVPPRDQQTPKSRPCPRAPVASNRQSGGSAVSAPLSGARRAWKSAFAAPPRSRLRPQKGVPWTEKRARGGGRAGPCRRT

SEQ ID NO: 16881 - protein, 229 aa, Homo sapiens
MAAAPDVGNGGSKNVRKPRPGKCQPKSRHSLPQTQKPEEVRKCGGICLPVCLQDPGACPSWLPLEEGLRRPAFGHRTEAGPRGKGFGRHRGNSGLRAAEVTHGPCWEAADVPCLRLTKPHGLRVTAGCSEWRRNVVARQVPEASAELCSRNQPWAAATPGSLHPSPQPGVLEGTPTNLNRTLPSGIRGSQPLPQGQPPLPGRSSWETKTREPIPPPVRLEAREVGGVSL

SEQ ID NO: 16882 - protein, 159 aa, Homo sapiens
MDVVEVAGSWWAQEREDIIMKYEKGHRAGLPEDKGPKPFGSYNNNIDHFGMQHETELPPLTAREVKQIRREISRKSKWVKMLGEWDTYKNSRKLIDRAYQGIPMNIRGPMWSVLLNIEEIKLKNPGRYQIMKEKGKRSSEHIQQMDLDAAGTTLHPPGV

SEQ ID NO: 16883 - protein, 153 aa, Homo sapiens; identical to SEQ ID NO: 14127

SEQ ID NO: 16884 - protein, 371 aa, Homo sapiens
MGGPVLGHWWHSGGMSLAVPSLPPPGKSSVFLFLQEKKANNKKQKAKRVLEVQLQTLNIQKEELNTDLYHMKRSLRYFEEKSKDLAVRLQHSLQRKGELESVLSDVMATQKKKANQLSSPSKAGTEWKLEQSMREEALLKVQLTQLKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKNNQRISLLNQRQEERIREQEERLRKQEERIQEQHKSLQQLAKPQSVFEEPNNENKSTLQLEQQVKELQEKLGEVKESETSTPSKKGWEAGSSLWGGEVPGQRQLPAWGLVTTAPPRAVLFLASCL

SEQ ID NO: 16885 - protein, 127 aa, Homo sapiens [sequence omitted]

SEQ ID NO: 16886 - protein, 754 aa, Homo sapiens
MKVIVIHRKMFQRAQELRRRAEDYHKCKIPPSARKALCNWVRMAAAEHRHSSGLPYWPYLTAETLKNRMGHQPPPPTQQHSITDNSLSLKTPPECVLTPLPPSADDNLKTPPECVLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAFHPQRMIISRHLPSVSSLPFHPQLHSQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 16887 - protein, 269 aa, Homo sapiens
MDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDSEYLTVKVISLHLVFQIGVIFLQ

SEQ ID NO: 16888 - protein, 189 aa, Homo sapiens [sequence omitted]

SEQ ID NO: 16889 - protein, 227 aa, Homo sapiens
MSHHTRTLGVVLSPQQGAPAGPGGGLGTPYHSHPCKPRQVPVSESQPPPHTMQVGRWAGLGVGQAEATSVRLGLHGLEAVFPYLGHDLQGPAVSHGDGLAGVGRELALLLGGPEQRGAKHRAKVVQGHLIDCLLLCHPVEDRSRGCCFNATTRREAEGLCRARVLREGVTSTLAVLQADSSLGVSSTRRTAAGGAARAAAHGQSCPRATPATTPSPGSPRQGRLSME

SEQ ID NO: 16890 - protein, 340 aa, Homo sapiens
PVPGPTSSATNVSMVVSAGPLSSEKAEMNILEINEKLHPQLAEKKQQFRNLKERCFVTQLAGFLANQQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMTSVGSSEKGGPRGNRSQAQQGAAG

SEQ ID NO: 16891 - protein, 3807 aa, Homo sapiens
  MOD_RES (1)..(1): Any amino acid
XPGPTSSATNVSMVVSAGPLSSEKAEMNILEINEKLHPQLAEKKQQFRNLKERCFVTQLAGFLANQQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRIGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDGEYLSMKVIRIH

SEQ ID NO: 16892 - protein, 85 aa, Homo sapiens
EMQKAEEKEVPEDSQEECAITYSNSHGPYDSNQPHRKTKITFEEDKVDSTLIGSSSHVEWEDAVHIIPENESDDEEEEEKGPVSP

SEQ ID NO: 16893 - protein, 250 aa, Homo sapiens
EIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDGEYLSM

SEQ ID NO: 16894 - protein, 99 aa, Homo sapiens
MRPKTLRNSAARSRKEPGFLNHHMEGSCLQLGELSSVGYWMESHSVTQAGVQWCSFGSLQPPPPRFKPFSCLSLPSSWDYRRKKGSWLGSKLEFPMLCG

SEQ ID NO: 16895 - protein, 99 aa, Homo sapiens; identical to SEQ ID NO: 16894

SEQ ID NO: 16896 - protein, 106 aa, Homo sapiens
MRPKTLRNSAARSRKEPGFLNHHMEGSCLQLGELSSVGYWWPFGHPGPAQGHLPVAVWASWVVAGISIALYLPPHPEGRYEGPFKRHTKTFRSAQCADCLTCALEP

SEQ ID NO: 16897 - protein, 150 aa, Homo sapiens [sequence omitted]

SEQ ID NO: 16898 - protein, 161 aa, Homo sapiens
MGHRPNLGQPPHPNAVAAALHASLCPANRGTCPLGKPGYPGCLWFQPLLLFPGCLCSPDGPFPRAVFTSAGKGPLQTDLGRGRVPPRDQQTPKSRPCPRAPVASNRQSGGSAVSAPLSGARRAWKSAFAAPPRSRLRPQKGVPWTEKRARGGGRAGPCRRT

SEQ ID NO: 16899 - protein, 106 aa, Homo sapiens
MHSRPWAWGASEMCFCFFEMGSFCCPSRSTVARSQLTAASTSWAQVILPPQPPECLLLVFMMTWGPGILHLCCSGASPAPGAHQPQLRREALICRAKQLCFHVDPA

SEQ ID NO: 16900 - protein, 81 aa, Homo sapiens [sequence omitted]

SEQ ID NO: 16901 - protein, 239 aa, Homo sapiens
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEVTFLMQNREPLTTLAEFLPELGNSSKPLTRE

SEQ ID NO: 16902 - protein, 171 aa, Homo sapiens
MLTSKLRSTLQTLQGLGLTSSCLLDIFSSVSTHIRNLPCLNLTLASSCLQRIQIMQGAGRKRNRGRAEKQKACAISFQVDFSKLHILGAGRGRILEEKQGILVRQANADCLRDLGLKSAFELAFRRSSLVFSPRAKGLKSSAEDRRWPLFWQNMVSIFGARCKASSAQTSC

SEQ ID NO: 16903 - protein, 405 aa, Homo sapiens
MHINSLHMQLNSHRICNSTHTVYANQLALRMQLNSHCVCNSTRTAYANPLTAYATQLALRMQLSSLCVCNPARSAYATQVALRMQLSSLCVCNSARTAYATQLALRMQVSSLCVCNSARSAYATQLALRMQLSSHCVCNSARSAYATQLALRMQLSSLCVCNSARTAYATRTAYATQLALRMQLNSHCVCNSTRTACATQLTLRMQLSLLCVCNSTRTAYANQLTAYATQLALHMQRNSTHTAYATQLTLYATQLALHMQFNSHCVCKSTYCICNSTHCVCNSTRTAYATQLALRMQLNSHCVCNSARTAYATQLLQVLISGHFLFLTTTPSQYFSSLKSAQDEALDSRTCCMPLGLLEVCRLASPRLHPALSCLSCENPVASASPGSDFCLLPSSAAPLGPCLE

SEQ ID NO: 16904 - protein, 136 aa, Homo sapiens
MRQEVEGRGRGSHELIITDKRCGVCGGSLSCIVYLCISLNFSRIKKLKKYTWPGPTRDSPNASLQPGRAKFAFSHASHTPLHSQLGALQTGKPQALLASANPLSRSMGPPDHHLTTLILISLETPFPGLLSSGCFP

SEQ ID NO: 16905 - protein, 335 aa, Homo sapiens
MQLLGLLGLLWMLKASPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSPITSSITSTNTVTSMTTTASQPTATNTLSSPTRTILSSTPVLSTETITSGITNTTPLSTLVTTLPTTISRSTPTSETT

SEQ ID NO: 16906 - protein, 143 aa, Homo sapiens [sequence omitted]

SEQ ID NO: 16907 - protein, 210 aa, Homo sapiens [sequence omitted]

SEQ ID NO: 16908 - protein, 210 aa, Homo sapiens
MSRAGSHPKPAIPGRGGEKLALLLAMLGGRCCPAGGPESHTPRKPWPPIRRERPGLRSPKPREEAGPRADSKAASPALFMGPGSRGRRRPPSWARRRARGGRGSCPEPHVRAGPRFFIALAAQAARGLRVSSQGPGLWRGPAARKEGVARVGVAAGLRLRPRGRGRKTTPALSGHPARFPLQPGDSRERSRNHRALELTWQPRGAKAGGA

SEQ ID NO: 16909 - protein, 626 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTVTNSGSSVTSSGASTATNSESSTVSSRASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTVSSGASTATNSESSTTSSGASTATNSDSSTTSSGAGTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 16910 - protein, 130 aa, Homo sapiens
MEGREVYLWYSVDSRGDFLVFLCPIFFSFSFSEVESLSPRLECSGTISAHCNLCLLGSSYSPASASRVTGITGMCHHAQLIFVFLVEMEFRHVGQTSFELLASSSPPASASQSAGITGVSHCAWPLAQYL

SEQ ID NO: 16911 - protein, 152 aa, Homo sapiens [sequence omitted]

SEQ ID NO: 16912 - protein, 165 aa, Homo sapiens
MSHPQATSNLQHTVSNSDNIGSSAGRWTWVPLTWTDTSKMSMRGLLDLFSFHSCILKNGSEPEEPQDSAKTDTQLSPATLALEREEHSSRHVPSVLSKTMSRASAELTCTAGRQGPGPPGSHSQAPHMLPQPEPLLACAPAMWCRREPQPIGGLQPPHLRLHLES

SEQ ID NO: 16913 - protein, 124 aa, Homo sapiens
MLPSKAFEFATVKSMHGIFGCGLALPPVFAAELLYLTRACASDEQPFITALRPPPRPPPSALQFISRLVPIATCGLGGPPDILSFGSPVTPELLPFWGAHICDTLVCPVHFLHLEFLSCSHISI

SEQ ID NO: 16914 - protein, 88 aa, Homo sapiens
MRSQGQGGPGAWRRMESWSAEPAGPGQGRLGSPCEAAEQASFEKTVIGVGQARAALSEEEHRVWEAAAGVGGLEQWGCWEAGVTSGWG

SEQ ID NO: 16915 - protein, 148 aa, Homo sapiens
MSSFVVVMGFLVEMTSRKKNNVKEEEMECAVTYLRKGGGICSFYFYFYLFFIFIYLFFLRWSLALSPRLEWSGAISAHCNLRLPGSCHSSASASRVAGTTGARHHALLIFYIFSRDGVSPWSRSPHLVVCPPWPPKVLGLQAPATTPG

SEQ ID NO: 16916 - protein, 124 aa, Homo sapiens
MTLNEHAAFKHLFNKAHLAPPLIHLTLSGHSTCFREHRVGGKVTDQQDPKAEEFFLVQNKMKSLPCLLLSTQTRQPSDFSIFSPPFPPVYSTKPPLSSWPVLNELLGTPPRRGGGRAEGLLTSQ

SEQ ID NO: 16917 - protein, 142 aa, Homo sapiens
MRIRTSFFMSAALGGRPPPARTEWTPLTRSTHPTAPPASLFGRRGPPRRPLSCFPAREPGQRQLRLLRPSGLWRRRRRRRRRRRRRRRRGRRHAARDTRFRNANALCAGTALPLSGRRSAGPGSLAHPPLGTATPETLGPGI

SEQ ID NO: 16918 - protein, 658 aa, Homo sapiens
LKTPPECVLTPLPPSADDNLKTPPECVLTPLPPSADDNLKTPPECLLTPLPPSADDNLKTPPECLLTPLPPSADDNLKTPPECLLTPPPPSADDNLKTRAECLLHPLPPSADDNLKTPSERQLTPLPPSAPPSADDNIKTPAERLRGPLPPSADDNLKTPSERQLTPLPPSAPPSADDNIKTPAFHPQRMIISRHLPSVSSLPFHPQLHSQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 16919 - protein, 195 aa, Homo sapiens [sequence omitted]

SEQ ID NO: 16920 - protein, 150 aa, Homo sapiens [sequence omitted]

SEQ ID NO: 16921 - protein, 113 aa, Homo sapiens
MAVSRMSKWRLSRVGGSRSLPAEMEVLGEVWCVRAEEQPMTGLGIVWHSPLDKALETWSLQQQPDFSLGLGHLGLGLYILASYLLCPRQPPSQPDGPCGSPNPVSGAKKTTVA

SEQ ID NO: 16922 - protein, 75 aa, Homo sapiens
MHIYFTAELLKRRNAKPTFSMSSMQAARSIPKSMNVHSMPSFLYSSCSSTNMWWLKNCCSFSLVKLMHSCSRLLN

SEQ ID NO: 16923 - protein, 186 aa, Homo sapiens
MWNQQGRPGIRNQFSLFFFLTQSLALSLRLECSGAISDHCNLRLLGSSDSSASASRVAGIIDVRHMPGQHGETLSLLKIQKLAGCGGSHLYSQLLGRLKWEDGLSSGGRGCSELRGRHCAPGWVTARLCLKKKKKRGGGKTKLYSVGLEFNIWKVDIWNALVPLDLWFSLKGESRTIVLESSEVRT

SEQ ID NO: 16924 - protein, 152 aa, Homo sapiens [sequence omitted]

SEQ ID NO: 16925 - protein, 27 aa, Homo sapiens
MSPALTFPRRWIAEGLVENLNPPGADA

SEQ ID NO: 16926 - protein, 52 aa, Homo sapiens [sequence omitted]

SEQ ID NO: 16927 - protein, 126 aa, Homo sapiens
MPNFAKSLFIHPINFFLLFSTEFCSVSQAGVQWRDLGSLQPLPSRFNRVSCLSLPSSWDYRLMPVIPALWEAKAGGSPEVRGSRLAWSKWQNPVSTKNTKKPQNCPGMVAHACSPNYSGGGGRRIT

SEQ ID NO: 16928 - protein, 166 aa, Homo sapiens
MTAGTVVITGGILATVILLCIIAVLCYCRLQYYCCKKDESEEDEEEPDFAVHSHLPPLHSNRNLVLTNGPALYPTASTSFSQKSPQARALCRSCSHCEPPTFFLQEPPEEEEDVLNGGERVLYKSVSQEDVELPRGAFGGLQALNPNRLSAMREAFARSRSISTDV

SEQ ID NO: 16929 - protein, 387 aa, Homo sapiens
MYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 16930 - protein, 223 aa, Homo sapiens
MFPVSSGCFQEQQETNKSLPRSASTPETRTKFTQDNLCHAQRERLDSANLWVLVDCILRDTSEDLGLQCDAVNLAFGRRCEELEDVRHKLQHHLHKMLREITDQEHNVVALKEAIKDKEEPLHIAQTRLYLLSHRPNMQLCREAAQFSAVGEASRRGAVPLQPRGHPHEPGEGCYRHDQQSLHRPPEVHGPSYLLHPHPAAGWLPVSSGTVLPPNPPNKQCIS

SEQ ID NO: 16931 - protein, 129 aa, Homo sapiens
MFPVSSGCFQEQQETNKSLPRSASTPETRTKFTQDNLCHAQRERLDSANLWVLVDCILRDTSEDLGLQCDAVNLAFGRRCEELEDARHKLQHHLHKMLREITDQEHNVVALKEAIKDKEEPLHIAQTRL

SEQ ID NO: 16932 - protein, 175 aa, Homo sapiens
MRLPGAPALPDADFLVHLHFLVQTSWFICNFLVRIPWASALPDAPALLVILEKTFPEHATCRGCWVSGYLCWTAPGNCICSANVGFLKIENTYRQIHHTHMHRHTHTHTDKSITHTCTDTHTQSQRHRLTSRALRLFILNAITDTSKFGAAVFFYVYCLFADSVYKFFPFLPPFR

SEQ ID NO: 16933 - protein, 646 aa, Homo sapiens
MEVINLTTLPMIPVDEHLAVSLVARNTMVKTVRKELENNPPSCLIGSMHQVNQKIADINLRTEPSANSLAIERFELEKKALREKTRSSPEDKVKRQRKSQYSCKGSELRHARSSVIKRKTADKNLLAELYQYSNFNSSKPNKLPNGVDFCDMVGNVVRAERDCLSGKHFCSGRELEKFLSSSSPRAIWLDSFWWIFHERYQPNKELQNNLFDRIAQHYALLLFRVPKSHSEEALLKRLPSLLSKAVYTSFCCCFPQSWFDTHEFKSDICNTMSLWISVGTYPSPQSYDSWDYSELDPERFRREELMLYRRRLTKGREFSLFAGKRAFSQKPAQSRKFYHPQSSSANSPSEKTSSAKQNSEKSLRMQNTAKEHHCQTLVLKKPTQEVKRISEARECENMFPKKSCAACKSPELTSNLFNIYGKSPLIVYFLQNYASLQQHGKNVLIVRREKTTSTPDCTPTYTDVISETLCSMKKRKDNLNQLYQHHWTEWNYFDKHLKELQDNFSREMKNIDPKAADTKKANHMFIPPSAVNEESPDKKTKGSLQREIEFKGCSNKNHGKGRSVNMRGKEEREREEKQKLNISFHSLPSPEELHNLEPGSAYRIRDISATRTPLRRPSSWEPSLIYQEQVLLKTHTLSMEEDKFRC

SEQ ID NO: 16934 - protein, 291 aa, Homo sapiens
MDVVEVAGSWWAQEREDIIMKYEKGHRAGLPEDKGPKSFGSYNNNVDHLGIVHETELPPLTAREVKQIRREISRKSKWVKMLGEWDTYKNSRKLIDRAYQGIPMNIRGPMWSVLLNIEEIKLKNPGRYQIMKEKGKRSSEHIQQMDLDVSGTLRRHIFFRDRYGTKQRELLYILLAYEEYNPEVGYCRDLSHIAALFLLYLPEEDAFWALVQLLASERHSLQGFHSPNGGTVQGLQDQQEHVVATSLPNTMWHQSASRRRPGVARGHVFGTGSLMPGPGMMTLCSSILGPL

SEQ ID NO: 16935 - protein, 139 aa, Homo sapiens [sequence omitted]

SEQ ID NO: 16936 - protein, 221 aa, Homo sapiens
MSALVFFPPSSPLPIAFFPPSSPLPIAFFPPSSPLPIVFFPSLFSIFLPPPYPHLLLAAASSCRAFLSPHHLLFLFPTVLSPRPLLSLSSPRAFPTTVFSPVFFPSHRFLPMSSHRLAAASVSRNLLPTFFSPPPIVFFPQPLILRHLLPLPTFSQQRLPAAFFSPRTLFSPLPLPTVFAPDRLLAHPLLALSNCLSPRSAPRVRPPVSLRLVCLCAQPAP

SEQ ID NO: 16937 - protein, 582 aa, Homo sapiens
  MOD_RES (1)..(1): Any amino acid
XPGPTSSATNVSMVVSAGPLSSEKAEMNILEINEKLHPQLAEKKQQFRNLKERCFVTQLAGFLANQQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRS

SEQ ID NO: 16938 - protein, 157 aa, Homo sapiens
TLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTY

SEQ ID NO: 16939 - protein, 171 aa, Homo sapiens
MAEMRAWRPLVRPSLQCVKLGRATARWWWVVKVKPHDKDAKMKYQECNKIVKQKAFERAIAGDEHKRSVVDSLDIESMTIEGEYSGPKLEDDKVTITFMKGLMQWYKDQKKLHQKCAYQGLALSPRLKCSGTITAHCSLNLLGPRDPPTSASQVAVTEGMHHHTWLIFLFL

SEQ ID NO: 16940 - protein, 31 aa, Homo sapiens
MLEAILGPVSNSLYVSGKTCHGSRSVFSSAK

SEQ ID NO: 16941 - protein, 74 aa, Homo sapiens [sequence omitted]

SEQ ID NO: 16942 - protein, 630 aa, Homo sapiens
MDPSWRRSSHSWPQPMPDSGRAPVRPHLAKLEEDVWPCPQFHQTKAASGPPFVNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 16943 - protein, 157 aa, Homo sapiens [sequence omitted]

SEQ ID NO: 16944 - protein, 245 aa, Homo sapiens
KEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDGEYLSM

SEQ ID NO: 16945 - protein, 85 aa, Homo sapiens; identical to SEQ ID NO: 13969

SEQ ID NO: 16946 - protein, 308 aa, Homo sapiens
MHTQVCAHTYIRMHRHLCTHMQIHPQHPICATHRHRYMETDAHTGLCTHIRMHRHLCTHMQIHPQHPICATHRHRYMKTDAHTGLCTHVCMHRHLCTHMQMHPQYPICATHRHTYMETDAHTGLCTHVHMHRHLCTHMQMHPQYPICAIHRHTYMETDAHTGLCTHVHMHRHLCTHMQMHPQYPICATHRHTYMETDVHTGLCTHVHMHRHLCTHMQMHPQYPICATHRHTYMETDAHTGLCTHVHMHRHLCTHMQMHPQYRICATQTYVHGDRCTYRSMHTCTHAQAPGHTLYLLICSSPPCRLLGR

SEQ ID NO: 16947 - protein, 99 aa, Homo sapiens [sequence omitted]

SEQ ID NO: 16948 - protein, 104 aa, Homo sapiens
MAALIPQGFSCLSRVLGWWSRQPVLVTQSAAIVPVRTKKRFTSPIYQPKFKTEKEFMQHARKAGLVIPPEKSDRSIHLACTAGIFDAYVPPEGDARISSLSKER

SEQ ID NO: 16949 - protein, 121 aa, Homo sapiens [sequence omitted]

SEQ ID NO: 16950 - protein, 522 aa, Homo sapiens
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLREQEERLREQEERLREQEERLHEQEERLHEQEERLCEQEERLREQEERLCEQEERLREQEERLCEQEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 16951 - protein, 260 aa, Homo sapiens
MLRNELQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSSPREMQKAEESKVPEDSLEECAITCSNSHGPCDSNQPHKNIKITFEEDKVNSSLVVDRESSHDECQDALNILPVPGPTSSATNVSMVVSAGPLSSEKAEMNILEINEKLRPQLAEKKQQFRSLKEKCFVTQVACFLAKQQNKY

SEQ ID NO: 16952 - protein, 100 aa, Homo sapiens
MAKNKFRGQKSRNVFRIASQKSFKAKNRVKPITANLKKIHIMNDEKVSRVNKAFGSVQEELPHFSKGLSLDLLQKELIPQQRHQSKPVNVDEATKLMAQL

SEQ ID NO: 16953 - protein, 552 aa, Homo sapiens
MLKSRISMRSRHPRRAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEEDDDDDDDDVIIQD

SEQ ID NO: 16954 - protein, 175 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNRVAQKHLHPHPVGPPSNILSVRGSIFVIANGP

SEQ ID NO: 16955 - protein, 75 aa, Homo sapiens [sequence omitted]

SEQ ID NO: 16956 - protein, 129 aa, Homo sapiens
MLCPCIQESTFETCLFMAVSRMSKWRLSRVGGSRSLPAEMEVLGEVWCVRAEEQPMTGLGIVWHSPLDKALETWSLQQQPDFSLGLGHLGLGLYILASYLLCPRQPPSQPDGPCGSPNPVSGAKKTTVA

SEQ ID NO: 16957 - protein, 95 aa, Homo sapiens
GRKEGEEDQNPPCPRLNSVLMEVEEPEVLQDSLDRCYSTPSMYFELPDSFQHYRSVFYSFEEQHISFALDMDNRFFTLTVTSLHLVFQMGVIFPQ

SEQ ID NO: 16958 - protein, 180 aa, Homo sapiens
MGLGAVEQEAALAGEAPAAQVPTEGVGGSGMAGCRSRALPLGKAARAPGEIERSAGGSALLGDPVHPPQPLARVLSPSLPGAGRACRLLRVRAAKLTPTQNSSWPASVACSPGSCSHLSLHTSLQAEGAGSGLGKPRKGLPQCSGGLKGSSSAAKVGAQAEEAPRASEGSEDCQHAVTSH

SEQ ID NO: 16959 - protein, 129 aa, Homo sapiens; identical to SEQ ID NO: 16956

SEQ ID NO: 16960 - protein, 138 aa, Homo sapiens
MIFPQIYLDYFKMRQDYCQSLNVWSYLPWIFFSFGLGFINNLNIISYRITKEEVNLIHLRLQPKIQSNSSFSLSCFFFMFLLLIAARILHRISIEMYEILWSLHVRIAQYVTIQFQREPTFVRFTDQGVVEEVELQIR

SEQ ID NO: 16961 - protein, 167 aa, Homo sapiens [sequence omitted]

SEQ ID NO: 16962 - protein, 385 aa, Homo sapiens
MAYLGPYPTSRQPPQMRLLPHNSLHRHSSIVTMASLDPAPASQPSLQALNFLKSTSPGPAHASLQPLQAQLLHLGGPSRPSLCLPSASTVPTSASQQILHAQHLPHCGPPKPSSQPFSSFYTPSSRLPVASSGPWGSFLTTAFPGPVFPFRRPLRAQNLLKSASPDPLAPSGRSLRAQLFFLVGSPGPIPASQQPLWTQCLPISWRPWSAHSFLKPSSPGPGQASRWPLQDELLPSDGISRPQMVSGRWAPPRQGWASRRPPQAQVVLKSGSPGPASQQVSKLFWLNSCPAPNRLCRPRTFSSQALRAHLLPPGGLYSSSTGWRTASAGPSLASQGPLQAQLLPPRRPPGAKSLPASQQPACGPAPPSRWPVDAQLMPLAPCPEA

SEQ ID NO: 16963 - protein, 140 aa, Homo sapiens [sequence omitted]

SEQ ID NO: 16964 - protein, 124 aa, Homo sapiens
MTPNEHPAFKHLFNKAHLAPPLIHLTLSGHSTCFREHRVGGKVTDQQDPKAEEFFLVQNKMKSLPCLLLSTQTRQPSDFSIFSPPFLPFYSTKPPLSSWPVLNELLGTPPRRGGGRAEGLLTSQ

SEQ ID NO: 16965 - protein, 154 aa, Homo sapiens
MGLWQQISNCMPDLALCSDIKFFLRCLERWLNRNSSALQLPARSTQKEIISAFPTKVPSSSHWDWLDSGCSPQKASRSRVGCCLTREAQGVRELPPLAKGSCEGLCREERGIPAQILCFPHGLCNPQTRRFPWVPAPPGPWVSSKKLGSHLGRH

SEQ ID NO: 16966 - protein, 55 aa, Homo sapiens
MVQSASVSKAGKGSSSSHGVAAALNQDLDPDPKCHVFNVSSQRCQMGSAQPCLCC

SEQ ID NO: 16967 - protein, 206 aa, Homo sapiens
MHHNKQATENAKEEVRRILGLLDAYLKTRTFLVGERVTLAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGREETQTLVREYFSWEGAFQHVGKAFNHGKIFK

SEQ ID NO: 16968 - protein, 165 aa, Homo sapiens
MSCSRSRSLEASSSRGTLPASWVRGSRCLGSSFADEGQAPLHADRPRFFGTVLTSFPSEKLAAKALLWGALNFFLGPNWSESEFPWPSFLPILGAGGAVDFLPRDLFIIFLCSVLPRPSAVPASPPSPFSLLPPFPTLPLSPFSLSRILGCSNQRAVSLFFPHYC

SEQ ID NO: 16969 - protein, 385 aa, Homo sapiens
MAYLGPYPTSRQPPQMRLLPHNSLHRHSSIVTMASLDPAPASQPSLQALNFLKSTSPGPAHASLQPLQAQLLHLGGPSRPSLCLPSASTVPTSASQQILHAQHLPHCGPPKPSSQPFSSFYTPSSRLPVASSGPWGSFLTTAFPGPVFPFRRPLRAQNLLKSASPDPLAPSGRSLRAQLFFLVGSPGPIPASQQPLWTQCLPISWRPWSAHSFLKPSSPGPGQASRWPLQDELLPSDGISRPQMVSGRWAPPRQGWASRRLPQAQVVLKSGSPGPASQQVSKLFWLNSCPAPNRLCRPRTFSSQALRAHLLPPGGLYSSSTGWRTASAGPALASQGPLQAQLLPPRRPPGAKSLPASQQPACGPAPPSRWPVDAQLMPLAPCPEA

SEQ ID NO: 16970 - protein, 169 aa, Homo sapiens
MVPRAPPCAWLRPGRRAQAGEGPRDPGNAAWRTRRTGFPEATGPARHLQLLYVDFGRWTHGRPVPLCRAGWRPQCPGAAAALGLAGLGDHIWPPGRTVPQDPPAWAPPSSLAHSLGAPVGAGAAGCPCGPAIHRPAHAASPSTCLPTPPQPPTSHLEETMGPAPPAPGC

SEQ ID NO: 16971 - protein, 260 aa, Homo sapiens
MGDNLWLGLRAQDPWRALRPAQSPRACRPHADCGDQGFRRKAQTPQLNPPTDHKVPEQRDEGAVHLLSRPGRARPQIRRAPAPHNSRTTTAGGLPSIRPGRPEPPPALSDHLGAGLSVLSQDGAVRIPPQGLPDLLELRRDAPTLESRPAAAALSLLFQAASSAARRAMSPAQETYSSSPHPLRRLDRFRPLEATWGGPHWKPLPGIHSVPKAYSTENSRSGRCKPGLVGACRASPTPDTPPGVGAEQSSGQPLTTRCRT

SEQ ID NO: 16972 - protein, 407 aa, Homo sapiens; identical to SEQ ID NO: 16878

SEQ ID NO: 16973 - protein, 129 aa, Homo sapiens
MCCNYYGNSCGYGSSYGCGYGSGYGYGYGSSYGCGYGTGYSCGYGCGYGSGYGCGYGSSYGCGYGTGYSCGYGSGYSCGYGSGSGCGYGTGFGCGYGCGYGTGYGCGCGSGSGYCGYRPFCFRRCYSSC

SEQ ID NO: 16974 - protein, 47 aa, Homo sapiens
MALPQGLLTFRDVAIEFSQEEWKCLDPAQRTLYRDVMLENYRNLVSL

SEQ ID NO: 16975 - protein, 389 aa, Homo sapiens
MLLPPGSLSRPRTFSSQPLQTKLMTHNGLFRPIPYVTAASADEATASQQPPQAQLHRYNGLFRPSSCLPAFSPGPELSQVDLTRPSSCFFAASPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKLDSLVPTAASWWPMKAQNLLKLTCPGPAPASCQRLQAQPLPHGGFSRPTSSSWLGLQAQLLPHNSLFWPSSCPAHGGQCRPKTSSSQTLQAHLLLPGGINRPSFDLRTASAGPALASQGLFPGPALASWQLPQAKFLPACQQPQQAQLLPHSGPFRPNS

SEQ ID NO: 16976 - protein, 259 aa, Homo sapiens
TSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKLDSLVPTAASWWPMKAQNLLKLTCPGPAPASCQRLQAQPLPHGGFSRPTSSSWLGLQAQLLPHNSLFWPSSCPAHGGQCRPKTSSSQTLQAHLLLPGGINRPSFDLRTASAGPALASQGLFPGPALASWQLPQAKFLPACQQPQQAQLLPHSGPFRPNS

SEQ ID NO: 16977 - protein, 596 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTVTNSGSSVTSSGASTATNSESSTVSSRASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTVSSGASTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 16978 - protein, 477 aa, Homo sapiens
MLFSWVKRQRKSQYSCKGSELRHARSSVIKRKTADKNLLAELYQYSNFNSSKPNKLPNGVDFCDMVGNVVRAERDCLSGKHFCSGRELEKFLSSSSPRAIWLDSFWWIFHERYQPNKELQNNLFDRIAQHYALLLFRVPKSHSEEALLKRLPSLLSKAVYTSFCCCFPQSWFDTHEFKSDICNTMSLWISGTYPSPQSYDSWDYSELDPERFRREELMLYRRRLTKGREFSLFAGKRAFSQKPAQSRKFYHPQSSSANSPSEKTSSAKQNSEKSLRMQNTAKEHHCQTLVLKKPTQEVKRISEARECENMFPKKSCAACKSPELTSNLFNIYGKSPLIVYFLQNYASLQQHGKNVLIVRREKTTSATDCTPTYTDVISETLCSMKKRKDNLNQLYQHHWTEWNYFDKHLKELQDNFSREMKNIDPKAADTKKANHMFIPPSAVNEESPDKKTKEGKGGEGKRRETEVEHFFPLTSKP

SEQ ID NO: 16979 - protein, 181 aa, Homo sapiens [sequence omitted]

SEQ ID NO: 16980 - protein, 578 aa, Homo sapiens
MAEETQHNKLAAAKKKLKEYWQKNSPRVPAGANRNRKTNGSIPEKATSGGCQPPRDSATGFHREGPTSSATLKDLESPCQERAVVLDSRSVEISQLKNTIKSLKQQKKQVEHQLEEEKKANNKKQKAKRVLEVQIQTLNIQKEELNTDLYHMKRSLRYFEEKSKDLAVRLQHSLQRKGELESVLSNVMATQKKKANQLKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKKNQRISLLNQRQEERIQEQEERLRKQEERIQEQHKSLQQLAKPQSVFEEPEHLEAASQQNQQLTAQLSLMALPGEGHGEHLDSEGEEAPQPMPSVPEDLESREAMSSFMDHLKEKADLSELVKKELCFIHHWRDRRHQKTHHLLSEPGGCAKDAALGGGHHQAGAQGGDEGEAAGAAADGIAAYSNYNNGHRKFLAAAHNPADEPGPGAPAPQELGAADKHGDLREVSLTSSAQGEAREDPLLDKPTAQPIVQDHKEHPGLGSNCCVPLFCWAWLPRRRR

SEQ ID NO: 16981 - protein, 607 aa, Homo sapiens
MAEETQHNKLAAAKKKLKEYWQKNSPRVPAGANRNRKTNGSIPEKATSGGCQPPRDSATGFHREGPTSSATLKDLESPCQERAVVLDSRSVEISQLKNTIKSLKQQKKQVEHQLEEEKKANNKKQKAKRVLEVQIQTLNIQKEELNTDLYHMKRSLRYFEEKSKDLAVRLQHSLQRKGELESVLSNVMATQKKKANQLSSRSKARTEWKLEQSMREEALLKVQLTQLKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKKNQRISLLNQRQEERIQEQEERLRKQEERIQEQHKSLQQLAKPQSVFEEPEHLEAASQQNQQLTAQLSLMALPGEGHGEHLDSEGEEAPQPMPSVPEDLESREAMSSFMDHLKEKADLSELVKKELCFIHHWRDRRHQKTHHLLSEPGGCAKDAALGGGHHQAGAQGGDEGEAAGAAADGIAAYSNYNNGHRKFLAAAHNPADEPGPGAPAPQELGAADKHGDLREVSLTSSAQGEAREDPLLDKPTAQPIVQDHKEHPGLGSNCCVPLFCWAWLPRRRR

SEQ ID NO: 16982 - protein, 85 aa, Homo sapiens [sequence omitted]

SEQ ID NO: 16983 - protein, 570 aa, Homo sapiens
MNHFRKMEVINLTTLPMIPVDEHLAVSLVARNTMVKTVRKELENNPPSCLIGSMHQVNQKIADINLRTEPSANSLAIERFELEKKALREKTRSSPEDKVKRQRKSQYSCKGSELRHARSSVIKRKTADKNLLAELYQYSNFNSSKPNKLPNGVDFCDMVGNVVRAERDCLSGKHFCSGRELEKFLSSSSPRAIWLDSFWWIFHERYQPNKELQNNLFDRIAQHYALLLFRVPKSHSEEALLKRLPSLLSKAVYTSFCCCFPQSWFDTHEFKSDICNTMSLWISGTYPSPQSYDSWDYSELDPERFRREELMLYRRRLTKGREFSLFAGKRAFSQKPAQSRKFYHPQSSSANSPSEKTSSAKQNSEKSLRMQNTAKEHHCQTLVLKKPTQEVKRISEARECENMFPKKSCAACKSPELTSNLFNIYGKSPLIVYFLQNYASLQQHGKNVLIVRREKTTSTPDCTPTYTDVISETLCSMKKRKDNLNQLYQHHWTEWNYFDKHLKELQDNFSREMKNIDPKAADTKKANHMFIPPSAVNEESPDKKTKEGKGGEGKRRETEVEHFFPLTSKP

SEQ ID NO: 16984 - protein, 121 aa, Homo sapiens [sequence omitted]

SEQ ID NO: 16985 - protein, 157 aa, Homo sapiens [sequence omitted]

SEQ ID NO: 16986 - protein, 168 aa, Homo sapiens [sequence omitted]

SEQ ID NO: 16987 - protein, 268 aa, Homo sapiens
MRRAPDWVQRQAAPGSKCRVPWQRREFPSRGGRKQPQPGSRQRKQNPISLPGEQNGRKATPQAGALGALGIRGIPSLCQSEGTRWSRRGRRWAERCPPGVLGAGRSLRAQRSRLHSRPPPLSPLRKPGGSNQPRSAAAAGTHEACLQASGTTRGWKYHALPLRLDPRSGHAGSALKAGSCPRLGGGGRGRGEAGAPSRFWLPRSLQQLLPNEPRNADVQTLHPTPSHTRRGQRTGKGARGPRFWKSKNSPANRQSSALDFWITTSISF

SEQ ID NO: 16988 - protein, 108 aa, Homo sapiens
MLLTSQTVFFFFFFFLRQSLTLLSSLECNGTISAHCILRLLGSSKSPASASLVAGVTGMHHHARLIFVFLVEMGFHHVGQAGLELLTSGNPPALASQRAEITGASYRA

SEQ ID NO: 16989 - protein, 107 aa, Homo sapiens
MRPKTLRNSAARSRKEPGFLNHHMEGSCLQLGELSSVGYWWPFGHPGPAQGHLPVAVWASWVVAGISIALYLPPHPEGRYEGPFKRHTKTFRSAQCADCLVQCPASP

SEQ ID NO: 16990 - protein, 154 aa, Homo sapiens
MRDMERAGVTRVRQSLKTWVEHGPFSGDPGLPRSVRVELLTLVAGPARGRSGHRQPPPQPQSLRRPLWLSHSDPSLKFRTLGLREGSGAECLPPGTFLPFSWSFSAPELAHLSNARAPWIPLPGAFQIQQKQIFFFLESRTKSGMRSRGGKDSK

SEQ ID NO: 16991 - protein, 240 aa, Homo sapiens
MNKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNFSPNTRTQKARHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIRRGFIMLTRLVLNS

SEQ ID NO: 16992 - protein, 243 aa, Homo sapiens
MERRWLSLRSSSCSAPRLNTAWGMRSSPQATSSSSRNAASFLRLFRATRRAPSLCRLSLCRWPATSVTLAGTFPALLRRDNTLSCFSSRRLSRVAARASSWGKSPSRCSSSKPRSPNTQSGTSRSSSHLTRITFRWSRRKTCKEKGSLAGEWSKLSSCKCTSCDSPGGKVISQMASSLSDSTSLSSKTVSGRPGSMQRASSSRPAALRCSFCRSFSGVHSWLRLSCFRRLSLTSDRKTAKRLE

SEQ ID NO: 16993 - protein, 1346 aa, Homo sapiens
MDNKRDKAKAGAAARTPAARAPGLLTPRPPGSPRPPPPVTPAALRVLGAAGAVGRKPLAERAGGIGGATIPESAPRAGPTRSAGTSSRNPASRPPASGRGERAPPAKNTSPGPVSSPGRASGTTRPGPLGQKGLRISAEETVARGKATEAPKRSALSAGARRDTSGPTPGTPSPAMARRSRAAGTEVGLPRPAPSARPRPPTEGPRKSVSSASEHSTTEPSPAARRRPSAGGGLQRPASRSLSSSATPLSSPARSGPSARGTPRAPAHPSQPKPKGLQALRPPQVTPPRKDAAPALGPLSSSPLATPSPSGTKARPVPPPDNAATPLPATLPPSPPVTPPPPAALQSQAPPTLPATPHSSSLTCQLATPLPLAPPSPSAPPSLQTLPSPPATPPSQVPPTQLIMSFPEAGVSSLATAAFVASVSPSVSSPLQSMPPTQANPALPSLPTLLSPLATPPLSAMSPLQGPVSPATSLGNSAFPLAALPQPGLSALTTPPPQASPSPSPPSLQATPHTLATLPLQDSPLLATLPLQASPSPLTTVSLQDPPLVSPSLLASPPLQAPPHPQAPPSMTTPPMQAPPSLQTIPPIQVPHSLTSPSLQAPPSPLALSSLQATTSLGSPTLQATHSFLTMSPRQTQASLISPSRPASTPPDSPPLQAPLSLPASPPLQTSLSPAVSPLSSPLTIHPLQALSSLASHSPQAPLSSLIMPPLETQSSLAPPSLQTPPASLTTPPLENLPSLAPPPLQTASAPLTTPPLENLPSLAPPPLQTASAPLTTPHLETPPCPAPCPLQAPPSPLTTPPPETPSSIATPPPQAPPALASPPLQGLPSPPLSPLATPPPQAPPALALPPLQAPPSPPASPPLSPLATPSPQAPNALAVHLLQAPFSPPPSPPVQAPFSPPASPPVSPSATPPSQAPPSLAAPPLQVPPSPPASPPMSPSATPPPQAPPPLAAPPLQVPPSPPASPPMSPSATPPPRVPPLLAAPPLQVPPSPPASLPMSPLAKPPPQAPPALATPPLQALPSPPASFPGQAPFSPSASLPMSPLATPPPQAPPVLAAPLLQVPPSPPASPTLQAPRRPPTPGPDTSVSGPRLTLALAPGPPPPPSRSPSSTLSGPDLAGHSSSATSTPEELRGYDSGPEGGAAASPPPDAELAACHPAAWSRGPAPPLAFRGAPGAPLPWPPATGPGSADGLCTIYETEGPESATPAPGALDPGPSPGTSGGKAAAGAGAGASSRSPKQARLGELPLGALQASVVQHLLSRTLLLAAAEGAAGGSGGGPGGAEGGGVTGGARAALSDAELGRWAELLSPLDESRASITSVTSFSPDDVASPQGDWTVVEVETFH

SEQ ID NO: 16994 - protein, 669 aa, Homo sapiens
MFTLSLLSRGHGKLGQDKQKLEVYFEPEDYLNWRSPEDYVPVSKPQDKNNASQHSWSLFLPKTFSTRKGALILYSEGFAISAWTPKERRKGPYCPRGPWRKLDLELHTLQDLKEAILAYGRQQGEQDRAWQPYLHFRSQLESQAQRQIQPGHSAKRYLRGLLRTWPPDAMYRLWCAGYIKDSVLLQDSQLNVPKKLRPQQDLSGVPPKYHLLPVFPSFWIQQGKSFEQRQQGLDEGEAGAAGHVDQGPLAKNHGSQGTRLPPRRKQPWQEDETQAEDTSIENHLCLYASKESYNEKTQQTSRKAFGHGRIDHSWLPSDKSHITFCGGAFPNRKADLSDKQRNVKLHKARSSHLLQVLPAERSLFPPVASATGSRIITPGEVKKKKAPKALKLPPISEEPPRVLEPLKSQFKANEPPTELFILPVEIHYHTKQPPKEKAHRRGAPHPESEPESSEESTPVWRPPLKHASLETPWELTVHLPVDASRDTLSPQGSSSLPPASLGNLTLKGSKARHTRVHSQGKGVWKGDDDAPPHDVAPPLDLLPPIKGKKSPESQKGVDSPRTSDHNSPPSLPNMRVPRRALPAAQEDSSDPTLGHFLLGPDGEKVCLSLPGHTQTEALPSGKAYESVNSNISHEEEGPSSQHFLKDMAAAASDQGKDDDLETFSPKNSL

SEQ ID NO: 16995 - protein, 136 aa, Homo sapiens; identical to SEQ ID NO: 16904

SEQ ID NO: 16996 - protein, 126 aa, Homo sapiens
MPTQPPPGSGEVRQSPSGNGALVPTGQGCRGRNLPIQGYSPEGRPTASSQPAGAWHSESSQKGTACPLALGRGGARGGGQRKSRSGARAPGQPAEAGLSASPEKTRPEGRAERGRAVVWQSQPNRW

SEQ ID NO: 16997 - protein, 232 aa, Homo sapiens
MFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 16998 - protein, 211 aa, Homo sapiens
MAYLGPYPTSRQPPQMRLLPHNSLHRHSSIVTMASLDPAPASQPSLQALNFLKSTSPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSNSPGPPSASRWHQQAQL

SEQ ID NO: 16999 - protein, 217 aa, Homo sapiens
MTLLPRLALREEAARRGPLRAPVQPGLGERSPQRHREPKQGRVSQRWHPAREPLAATGFLHGLGHLGRAAQSPRASCCILWPGTWGDPLRTLGRSQREVQTVCTGVSGDQAQKEQDGHLLAWRKILLPGKKTTPRGIGLGCRTLSQATAPFLLQNWGRKRAFRPGSENPSSGTSRPSRGRLEARSSGLDEAWEAQRLTGHGRFPSPRKEKSLQRGLG

SEQ ID NO: 17000 - protein, 111 aa, Homo sapiens
MVSLWVEDTFLSPGFGFAHVACSGLGMKQKRKAASSEPTSEVALGGSAGPVRSHLHPEGLLWCSRCFFSLRPKGTEPPGRSAGLQGATERSGWTSVQAQAQACENLVPAAV

SEQ ID NO: 17001 - protein, 1700 aa, Homo sapiens
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGTHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 17002 - protein, 1635 aa, Homo sapiens
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGTHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 17003 - protein, 566 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTVSSGASTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 17004 - protein, 124 aa, Homo sapiens; identical to SEQ ID NO: 16964

SEQ ID NO: 17005 - protein, 271 aa, Homo sapiens
MFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLDWPRVSGQEGGD

SEQ ID NO: 17006 - protein, 123 aa, Homo sapiens
MQSEKPQGLFLQLNPNASSTETQLLVPALESRDTLPPTHCFMAGTESPLGNPWPLSLPPPCWTGCVLPAPRGQRKPGPLGLSIFISLGNKRHRSGNHVVRESEQPLSQGNPHQGWGPDTRKGR

SEQ ID NO: 17007 - protein, 33 aa, Homo sapiens
MLNFDISAAPRKTALMKLETIIHSKLLQGQKTK

SEQ ID NO: 17008 - protein, 33 aa, Homo sapiens; identical to SEQ ID NO: 17007

SEQ ID NO: 17009 - protein, 674 aa, Homo sapiens
MQFYTLKIILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 17010 - protein, 1635 aa, Homo sapiens
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 17011 - protein, 753 aa, Homo sapiens
MEFHRVAQAGVELLSSGDPPASASQSVGIIGVSHCTWHINFQGNYISYIDGNVWKAYSWTEKLILRENNLTELHKDSFEGLLSLQYLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 17012 - protein, 123 aa, Homo sapiens; identical to SEQ ID NO: 17006

SEQ ID NO: 17013 - protein, 291 aa, Homo sapiens
SAGGGGAGSRLQAEMLQMDLIDATGDSTPDEPDVHFSKKFLNIFMSGRSRSSSAESFGLFSCIINREEQEQTHRTIFRFVPRHEDEPELEVDDPLLVELQAEDYWYEAYNMRTGARGFFTAYYAIEVTKEPEHMAALAKNSDWVDQFRVKFLGSVQVPYHKGDVVLSAAMQKIATTRRLTVHFNPPSSCVLEISVRGVKIGVKADDSQEAKGNKCSHFFQLKNISFRGYHPKNNKYFGFITKHLADHRFACHVFVSEDSTKALAESVGRAFQQFHKQFVEYTCPTEDIYLE

SEQ ID NO: 17014 - protein, 684 aa, Homo sapiens
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGPGGHHQLQEAAAAEGAQKEDNEDIPVDFTPAMTGVVVTLSCSLMLLLYFFYDHFVYVTIGIFGLGAGIGLYSCLSPLVCRLSLRQYQRPPHSLWASLPLPLLLLASLCTTVIIFWVAYRNEDRWAWLLQDTLGISYCLFVLHRVRLPTLKNCSSFLLALLAFDVFFVFVTPFFTKTGESIMAQVALGPAESSSHERLPMVLKVPRLRVSALTLCSQPFSILGFGDIVVPGFLVAYCCPFDVQVCSRQVYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSPEGWSDAHLDPNELPFIPPRASEELMPLMPMAMLIPLMPLMPRPSELGHVHAQAQAHETGLPWAGLHKRKGLKVRKSMSTQAPL

SEQ ID NO: 17015 - protein, 123 aa, Homo sapiens; identical to SEQ ID NO: 17006

SEQ ID NO: 17016 - protein, 674 aa, Homo sapiens
MQFYTLKIILNHNPLTTVEDPYLFKLPALKYLDMGTTLVPLTTLKNILMMTVELEKLILPSHMACCLCQFKNSIEAVCKTVKLHCNSACLTNTIHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDPSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 17017 - protein, 130 aa, Homo sapiens
GARSPGSTHQGSLASGVLPIKCSHVEFGMWKGGRSHPFLPHSSRCAGSGGQLDSILPHQSPAWGPWGCKDLSSGFPSFLTSSILWKSAVVREPHISPHQAPPYKTSDCIRAISFPVCTIHQEIMRGHWHK

SEQ ID NO: 17018 - protein, 291 aa, Homo sapiens; identical to SEQ ID NO: 17013

SEQ ID NO: 17019 - protein, 530 aa, Homo sapiens
MSLKWTSVFLLIQLSCYFSSGSCGKVLVWPTEYSHWINMKTILEELVQRGHEVTVLTSSASTLVNASKSSAIKLEVYPTSLTKNDLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKKGKKKKRD

SEQ ID NO: 17020 - protein, 33 aa, Homo sapiens; identical to SEQ ID NO: 17007

SEQ ID NO: 17021 - protein, 124 aa, Homo sapiens
MTLNEHAAFKHLFNKAHLAPPLIHLTLSGHSTCFREHRVGGKVTDQQDPKAEEFFLVQNKMKSLPCLLLSTQTGQPSDFSIFSPPFPPFYSTKPPLSSWPIPNEPLGTPPRRGRGRAEGLLTSQ

SEQ ID NO: 17022 - protein, 157 aa, Homo sapiens
MHPWLGSALGFPKCRGIHLCACGNGWTPGETLSQNKTEITKNKVTCWRPHGCEPNTGLGYQGSHTSKYTLLPWNLLKTKPLPPSHGKEGGKEAKVPSGDNSGRGEVPRAQEGQAACGRAASGDSQEGMRRGCEERATAQRPAVRSAETTAHGTWIYP

SEQ ID NO: 17023 - protein, 203 aa, Homo sapiens
MGNIFEKLFKSLLGKKKMRILILSLDTAGKTTILYKLKLGETVPAVPTVGFCVETVEYKNNTFGVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVSYQLPSLHNSSRNYAGSLAQMMRHLLEA

SEQ ID NO: 17024 - protein, 566 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTTSSGAGTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 17025 - protein, 1635 aa, Homo sapiens
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTIHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDPSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 17026 - protein, 123 aa, Homo sapiens; identical to SEQ ID NO: 17006

SEQ ID NO: 17027 - protein, 753 aa, Homo sapiens
MEFHRVAQAGVELLSSGDPPASASQSVGIIGVSHCTWHINFQGNYISYIDGNVWKAYSWTEKLILRENNLTELHKDSFEGLLSLQYLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGTHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 17028 - protein, 125 aa, Homo sapiens
MGNIFEKLFKSLLGKKKMRILILSLDTAGKTTILYKLKLGETVPAVPTVGFCVETVEYKNNTFGVWDVGSHFKIRPLWQHFFQNTKELSASQFAQFIKKLCGVTGTNDEASPGSLTSYPSHLLDR

SEQ ID NO: 17029 - protein, 33 aa, Homo sapiens; identical to SEQ ID NO: 17007

SEQ ID NO: 17030 - protein, 173 aa, Homo sapiens
MPAMPSPLCAPARVSPSPLTAAPPFCSLSPILWVSLILLLTSISKCCESIFKFIQNPFTSHYFPCSHPSQGKRRLHPGILHSFPTVFPTASLVPHLSILFSAQQPERSFQRMSPTMSHFSKLSSPCHSEQRSTPFPHPSGLPALATPLTSLQFLCVQPFWLLPPSRNTDNFLP

SEQ ID NO: 17031 - protein, 291 aa, Homo sapiens; identical to SEQ ID NO: 17013

SEQ ID NO: 17032 - protein, 423 aa, Homo sapiens
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPQSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 17033 - protein, 124 aa, Homo sapiens; identical to SEQ ID NO: 16964

SEQ ID NO: 17034 - protein, 112 aa, Homo sapiens
CDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTVLQGTRLKISRVEA

SEQ ID NO: 17035 - protein, 127 aa, Homo sapiens
MEFGLNWVFLVAIIKGAQCEVQLVESGGGLVQPGGSLRLSCPDSGFTFSNHYMSWVRQAPGKGLEWISYISGDSGYTNYADSVKGRFTISRDNANNSPYLQMNSLRAEDTAVYYCVKHTARGNLQFY

SEQ ID NO: 17036 - protein, 104 aa, Homo sapiens
MTQSPSSLSASVGDRVTITCRASQSISSYLNWYQQKPGKAPKLLIYAASSLQSGVPSRFSGSGSGTDFTLTISSLQPEDFATYYCQQSYSTPPTVGSGTYFKLK

SEQ ID NO: 17037 - protein, 115 aa, Homo sapiens
MLWVPGSSGDVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPPTVVQP

SEQ ID NO: 17038 - protein, 115 aa, Homo sapiens
MRVPAQLLGLLLLWLRGARCDIQMTQSPSSLSASVGDRVTITCRASQSISSYLNWYQQKPGKAPKLLIYAASSLQSGVPSRFSGSGSGTDFTLTISSLQPEDFATYYCQQSYSTP

SEQ ID NO: 17039 - protein, 143 aa, Homo sapiens
MWVQTHPSSASYKSWGPGTADTHTMRLSRRPETFLLAFVLLCTLLGLGCPLHCEICTAAGSRCHGQMKTCSSDKDTCVLLVGKATSSKRMWPGTWWGGGVYLQGGRDYHAEGGSSWFSRRERGKKSVESRKEGKTIMRWREQK

SEQ ID NO: 17040 - protein, 312 aa, Homo sapiens
LALRPRRMASNRQRSLRGPSHPSHMEEPFLQMVQASESLPPSQTWAQREFFLPSESWEFPGFTRQAYHQLALKLPPCTDMKSKVRQRLIHPWKGGAQHTWGFHTWLDVCRLPATFPTQPDRPYDSNVWRWLTDSNAHRCPPTEHPIPPPSWMGQNSFLTFIHCYPTFVDMKRKKQVIFRTVKELKEVEKLKLRSEARAPPLDAQGNIQPPASFKKYRHISAGGRFEPQGLQLMPNPFPNNFARSWPCPNPLPHYQEKVLKLALLPSAPLSQDLIRDFQTLIKDRTALPLHHLSKAQASKSPARKRKRRPGHF

SEQ ID NO: 17041 - protein, 151 aa, Homo sapiens
MAVSQMSKWRLSRVGGSRSLPAEMEVLGEVWCVRAEEQPMTGLGIVWHSPLLDKALETWSLQQQPDFSLGLGHLGLGTDATWMQSFPGSGGDAQAGTGVSGLLRLYPNLLCDFGPRQGPLWALLLEKRQMAGTGGSPALLAWRSASWRALG

SEQ ID NO: 17042 - protein, 114 aa, Homo sapiens
MAVSQMSKWRLSRVGGSRSLPAEMEVLGEVWCVRAEEQPMTGLGIVWHSPLLDKALETWSLQQQPDFSLGLGHLGLGLYILASYLLCPRQPPSQPDGPCGSPNPVSGAKKTTVA

SEQ ID NO: 17043 - protein, 167 aa, Homo sapiens
MLCPCIQESTFETCLFMAVSQMSKWRLSRVGGSRSLPAEMEVLGEVWCVRAEEQPMTGLGIVWHSPLLDKALETWSLQQQPDFSLGLGHLGLGTDATWMQSFPGSGGDAQAGTGVSGLLRLYPNLLCDFGPRQGPLWALLLEKRQMAGTGGSPALLAWRSASWRALG

SEQ ID NO: 17044 - protein, 130 aa, Homo sapiens
MLCPCIQESTFETCLFMAVSQMSKWRLSRVGGSRSLPAEMEVLGEVWCVRAEEQPMTGLGIVWHSPLLDKALETWSLQQQPDFSLGLGHLGLGLYILASYLLCPRQPPSQPDGPCGSPNPVSGAKKTTVA

SEQ ID NO: 17045 - protein, 707 aa, Homo sapiens
MVDPVPEEEKAGAEPGDSGGDEAVASVPPDSQGAQEPAASSASASASAAVPRKAEVPCAAAEGGRREQSPLLHLDLFNFDCPEAEGSRYVLTSPRSLEACARCAVKPVELLPRALADLVREAPGRSMRVATGLYEAYEAERRAKLQQCRAERERIMREEKRRLFTPLSPAAAAAAAAAAASAPSAGSSSSCSSASLPASPAPRAARKASPSPSSARTQPPPAGSRTGRKSHSLDSLSRRREGALSSESGASSSSYSGESLRELRWPPRASARNSCPAGSASSTTNAPGRPSALTLVPITGRSFSLGDLSHSPQTAQHVERIVRQVRAERGLRGVPERDRKIAALMLARHQEELLLLEQRAAAHGQWELQRVHAKQRREREEREKQRALEQGRRAWAAQVEERRGRRGREEREAARRRQRQYERSEERRRELAERQGLLRRERAERAAREDRLRKLQQEQNLKQREEGLQEGRERAEQIRRERAQRAARAKQRQEGQLQREKRELSRAERARHEALLQGRTRQQRQEREGLRSSLEASLGRAQENYEHLVEQRTRELRERARREELQGRRAKEAAERKEREHQAHLEALARAGERRLQHATQVAEEAVQQKARRVGQSRLEKERAQRANKEKVERDEDCRRRELLQAIGRKLERSEQLTRERRSALESARSTARASFHVREKVREETNTRSFDRMVREAQLHASLDRK

SEQ ID NO: 17046 - protein, 65 aa, Homo sapiens
MSEQNICNQKDKSTLPFCQAHLCEETTNRLCVSNKAVYSLECKWAESENRVSEGRWGRGCFIGVG

SEQ ID NO: 17047 - protein, 158 aa, Homo sapiens
MRASRSPPSPRRCHHHHEATGAASGAAAGGPGAGCVGLCRLALTPSAQDGRNSTFQTYKKEVCLPRHSMHPGPWAICCECQTRFGGRLPVSRVEAALPYWVPLSLRPRKQHPCWMHAAGTTAGGSAVMSACCPSSSSSRPPTRTSYRLLQRVCCPSAS

SEQ ID NO: 17048 - protein, 555 aa, Homo sapiens
MRRPSTASLTRTPPRASPTRMPSRASLKMTPFRASLTKMESTALLRTLPRASLMRTPTRASLMRTPPRASPTRKPPRASPRTPSRASPTRRLPRASPMGSPHRASPMRTPPRASPTGTPSTASPTGTPSSASPTGTPPRASPTGTPPRAWATRSPSTASLTRTPSRASLTRWPPRASPTRTPPRESPRMSHRASPTRTPPRASPTRRPPRASPTRTPPRESLRTSHRASPTRMPPRASPTRRPPRASPTGSPPRASPMTPPRASPRTPPRASPTTTPSRASLTRTPSWASPTTTPSRASLMKMESTVSITRTPPRASPTGTPSRASPTGTPSRASLTGSPSRASLTGTPSRASLIGTPSRASLTGTPPRASLTGTSSTASLTRTPSRASLTRTQSSSSLTRTPSMASLTRTPPRASLTRTPPRASLTRTLPRASLTRTPPRASLTRTPSMVSLKRSPSRASLTRTPSRASLTMTPSRASLTRTPSTASLTGTPPTASLTRTPPTASLTRSPPTASLTRTPSTASLTRMPSTASLTRKSNVNQQCPASTPSSEVIS

SEQ ID NO: 17049 - protein, 572 aa, Homo sapiens
MPVYCKYQFHKTPVHKTKGEPHGTHVYFQDINVIFLGALHPSDLREYLEGPPMVVEVHDRDRKSEECSQKPVLFGEDPLDSYLNFQALISPRETENNPFESQNKMWYPYGIAQVSFADLLLGHKYLNLAVPIHSCEVQPTHCGQDSRRRKVVGLGVPRDGHQHGPMPRGNYLEADSQLKLRVDIAVPLRAGARAADPDLGGSQFGRIIFVFDFKKVSLLHSLLQDITMINAKALGLDSYPVRTLQQILSAFKVRVRVQEQQHLDVLTGFHLLDGKTHLFILEGLADQGLRQLWENHQSWIPRSEHRKYKVLYNSQLLFRSRLYGDLEAILYHVHLFQPTELLLQQAVFFLRDTERRRVFQALARIHDICYNSTTLWDVTVRDLLPSSAMIKDLSQEFGMPLSQEELTDEKLFALPPQPAPNLEDYHSRNSTLTLEIHAHQEPRKRFTYSQDYLSAMVEPLDLKEEEKKAQKKSRQAWLTARGFQVTGLQSDTESSFQDLKLPPIKELNEEWKENSLFANVLEPVLDRDRWSWDRHHVDFDLYKKPPPFLELLPSPAPKPVTVRKKKGNSPIS

SEQ ID NO: 17050 - protein, 572 aa, Homo sapiens; identical to SEQ ID NO: 17049

SEQ ID NO: 17051 - protein, 129 aa, Homo sapiens
MPVYCKYQFHKTPVHKTKGEPHGTHVYFQDINVIFLGALHPSDLREYLEGPPMVVEVHDRDRKSEECSQKPVLFGEDPLDSYLNFQALISPRETENNPFESQNKMWYPYGIAQVSFADLLLGHKYLNLA

SEQ ID NO: 17052 - protein, 355 aa, Homo sapiens
LGVKGLPLYPDPSRVPGTKTQNNLESDYLARDGPSSNSSFHSSEEEGTDLEGDMLDCSGSRPLLMESEEEDESCRPPPGKLGGAVPFAPPEVSPEQAKTVQGGRKNQFQAFTQPATDGLSEPDVFAIAPFRSSRVPNDDMDIFSKAPFVSKSSMAPSQPEESDVFLRAPFTKKKSMEELTVIQCTSQELPAQTGLLSQTGDVPLPAGRERAVYTSVQAQYSTAGFVQQSNLLSHSVQAADHLDSISPRGSCLESGGHSNDRNKGPQLQKEAVSGPMAGKPFRPQSLSKYSRHYSPEDEPSPEAQPIAAYKIVSQTNKQSIAGSVSITSLSSRTTELPAADPFALAPFPSKSGKKP

SEQ ID NO: 17053 - protein, 153 aa, Homo sapiens
MHYVHVHRVTTQPRNKPQTKCPSGGQSQGPRGQFLDTVLAAMCPIAMLLTADPGMPPTCLWHTPHAKHKEHLSIHLNMVPKCVHMHVTHTHTNSGSRYVGKYILLIKWSLAMYFVQGSTLSTVTKMSHGKALPDSDTYIQFPNQQGPHTPSIP

SEQ ID NO: 17054 - protein, 121 aa, Homo sapiens
MQKQLLPLAAGQRCDYSQRESCCQSPHRAESAGDRSTDNGLHRGAERSFCCALDPLPRRPPAGRRGRDRSSSACPGARARVWPPGACASFRDSHKRFIMRRTALFHFTPTSFHLRYTLRKL

SEQ ID NO: 17055 - protein, 127 aa, Homo sapiens
MLPSSTPGPGHATETCPAPPGPERSPAARAPAAASSLGPVSTAGRAPRGLDMSAQEPPQGRRFPIEAGDSRGLAAAPESQDSPEAVATEHNPVRPLRRCPGCHCLTLLHVPIDVYLAMGGSPRARAT

SEQ ID NO: 17056 - protein, 135 aa, Homo sapiens
MVPAPPFLGVLENPVPQWDLSILGSIRIRVSHTEVQGSGSSRSPEALRKESLEVEWTLVLLAIPPRIQPSQQDGGPPKCCDLLRAALLGRHCPLCVPAGEVFSQKRDNEQDRSEFIGQTLKLLVKRNVSLELSCR

SEQ ID NO: 17057 - protein, 238 aa, Homo sapiens
MPGRTGLAGEMPVGWGPGRAGASEPNESTCAPEALDGHLGVARREGPILGTLLGRGKGHCQALSQLGHCPSPAWNNYSGMMDIGVAPSRVGPSGHCGVLRSHSRPGELAVVMNHKVPRHRPVSSVGTELLWVRCAPKMVQLPICCLLLTPAPGIGPRAHGHLHTNLETRGLPRGTRESQQAEGEGEAIQEGRGACKRAQRKEGEGPRGPCVVRAGGVGWGTRQVAGEPPLVDCSTAGT

SEQ ID NO: 17058 - protein, 104 aa, Homo sapiens
MGLGDRRGRRRASASAAFRTASSSSCNCSRCSSADTRSSTSIPLVPDKLSSGRRGSAGCRATQELQCPRGPSRLPGSKRGASHAPFLSRYLGLGHLDMSQGRGL

SEQ ID NO: 17059 - protein, 65 aa, Homo sapiens
MPAKGKKGKGQGKSHGKKQKKPEVDILSPAAMLNLYYIAHNVADCLHLRGFHWPGAPKGKKGRSK

SEQ ID NO: 17060 - protein, 214 aa, Homo sapiens
ATMVWFCNSADCQFSVFALTTIGWILSSTSTGLVEWRIWYMKDTSLYPPGIACVGIFRVCIYRRRTNSTTTKFCYRYSYQDTFLPFEISMAQRFLLTASIFGFFGRAFNMFALRNMSMRMFEEDTYNSFVVSGILNIAAGVFNLIAVLQNYDAVINSQGITFLPSLQMPFKPDVQEVGTAIQVAGIGVLPMLLTGMFSLFYKCPPMLYQIFPTT

SEQ ID NO: 17061 - protein, 114 aa, Homo sapiens
MYTSLKSTFVAFADGRGTTESMPSPPLANSNHESPVNQLGNMQNMRLGPSFILTGIFLGNGRTEASPFFTDEFALSKIFPEYKRNLFGKFQTNMAFSLELDPPSLLLSVVLFMF

SEQ ID NO: 17062 - protein, 361 aa, Homo sapiens
MAPQRAGPGLGKPSSKKSRALRGGPGVPRARQRSPRAAAELNTEVPKPSAKDVEILEQESEVLEPSVEQDAESPGLSTAAGFESPEPGRDDPGPSEAQRAEVQGQHPPPGPKTSSSRSGSEAPHLRFPPCPEAPQRPPEERFMETPIEREIRRSCEREESLRRSRGLSPGRAGRELVELRVRPVLNLPGPGPALPRALERARAGAQMQRDIEREAHRQAALARPAVPEPRARSPPQPLGELKRFFEAAAGSGSSAGAGDGAGPQRLPEPGGRPRSAVQGGCRVLGSAPPPFTPSLLEQEVRAVREREQELQRQRRSVYGTAEFKEPTPSLTASRGDGKLVVIWPPRRKVSENGLEQEERKP

SEQ ID NO: 17063 - protein, 121 aa, Homo sapiens
MTDRNRDKKSTSPSNSDTEMKSEQLPPCVNPGNPVFSCMLDPKTLQTATSLSKPQMIMYKTNSSHYGEFLPIPQFFPCNYTPKEQVFSSHIRATGFYQNNTLNTAPDRTRTLDFPNIQHTL

SEQ ID NO: 17064 - protein, 186 aa, Homo sapiens
MEQPKDGAGPEGNNLSLPSSGTEPWPPAPLPAPPPLLLNSTDPTHLGLPESVASVTVPIRLDTLSCLLHSALLGAYTFQQALPSCPCCSQAGHSQPGAVRRPPRGRGGWEVRHRPGWGRGLHRRGLGRAEQPERGRAGGPGAGPRTPPMTLPSPPTLPAQDGKKEARGPEPPLETPLAAEDWETEY

SEQ ID NO: 17065 - protein, 118 aa, Homo sapiens
MQSLRPEQTRGLLEPERTKTLLPRESRAWEKPPHPACTKDWEAVEVGASSHDSDEKDLSSQETGLSQEWSSVEEDDESEGSQGFVEWSKAPQQTTIVLVVCVLFLFLVLTGMPMMFHI

SEQ ID NO: 17066 - protein, 104 aa, Homo sapiens
MGRIPGGCSSKAFIGRAQWLTPVIPALWEAKGLTLLSRLECSDVIMDHCSPQLTGLRMKGFLAQTPPLEFPVHQYQPGDHVLIKSWKRESLNQLRRTSSGTLDE

SEQ ID NO: 17067 - protein, 126 aa, Homo sapiens
MKKWKSRLFPRPPNWLSGKYLRLPSSAMFLIDFCLCVPWTTPFQCKILMVEFIVGFYDFCLALEVQYRTSKLFLCGQPSPRRSLGIQQQALKLACLSPTLLESSSCVDPPGNTAGSRMPSSSNCIK

SEQ ID NO: 17068 - protein, 220 aa, Homo sapiens
VEGEAPGLFLSSQEQRARDTEGPRQGDLEAGLGWGWPLHPGSNQGAPRQGGSIGSGTRPCPCPPLSREGGALASPRVALSQLQCGLLGSAEQSFLQLEQENHSLKRQNQELREQLGALLGPGQQFLPLCPEHSSCTALAWPPDPAGTQPLGNRAPLQLLRRELCQGQEAFVQQSQNELQQIRLCFERKKMVITEVWDNVAEMHMALNNQATGLLVGPHRA

SEQ ID NO: 17069 - protein, 120 aa, Homo sapiens
MYSFPTTVVEEILSLSLQLIAFPTVSCEILLEITSQTNKKQTWETCYAHSAEEIGIIAGKRIHKTQAVPYICFLLRHQFISQSSHVRVEALYSLLFLGTLLQVGKGQEVLLKDALRARAP

SEQ ID NO: 17070 - protein, 855 aa, Homo sapiens
MWSTGPEARDGDSSVSSGRLSCSSGGHDVCVSWKERPPQVLGPQQRPRKSDARLEQLRDKIRAQAWQQGSCASLGTSAPSSASRLHKASTLMLRRKGQEAKNPPPAPECSGFSILSAAERRVEAKASHGQGRELSRVSQHQVPVLREKPKRVKSSSCKREKTPKLPSPRRAAKDKHKDEDSELVGVYAWRKGQALVRSLLGPPPVLRRHHSKDPSRDPALTVDLGDSEKVIAAKCSPVCAQLPDATSAYSDQQVSGNTPSLASFDQPATIQTAMAILQDLRQQIQAGLELAQARKGGQELGPSKRRLQDVAGRGCCRDPNAQSSFSKSPWAMTERKHSSLERARSVHTWEPWSSSTARESCPQRAWGAQGQDRSFQRPESPHERLGHFSQRPWSALAGQACSPQRAWGAQRQGPSSQRPGSPPEKRSPFPQQPWSAVATQPCPRRAWTACETWEDPGPRLRNPLERPSPPAQRPWSSSGVQRAGPQGKGRGIGSPVSAAKHALPRPTGSFPQNPLGKEKDTLRPCPRSRGLLGPSHSSESLREFMRQKAQARRRQALEEKASALRTRELRSRRLQEVYRQQREAVLGRAVPVVSRTTPGIVTFVPSSAQSGGLEASGSLESPVLEWSKVTSGMVLGGQEAPGSFCLCLNRAWNHAETLDPPGMGGPQDGRDAPVLLSASPSLGSLELQDLTTRYLPRGMCIYLDPKEAEHLGTSSSLHLRHKQAQLQALETTAKVLKQRVDSLTAKLQGAEALDTVRDPAVGLLRSCPHSLPAAPTLATPTLATPACPGALGPNWGRGAPGEWVSMQPQPLLPPTYFLDGETLSWGPSWEQQQSVSPRAHCESKPRGVSQAPLLL

SEQ ID NO: 17071 - protein, 942 aa, Homo sapiens
MVVSAGPWSSEKAEMNILEINETLRPQLAEKKQQFRNLKEKCFLTQLAGFLANQQKKYKYEECKDLIKFMLRNERQFKEEKLAEQLKQAEELRQYKVLVHSQERELTQLREKLREGRDASRSLYEHLQALLTPYEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 17072 - protein, 88 aa, Homo sapiens
MAVSTEELEATVQEVLGRLKSHQFFQSTWDTVAFIVFLTFMGTVLLLLLLVVAHCCCCSSPGPRRESPRKVSPWKERPKGVDNLALEP

SEQ ID NO: 17073 - protein, 88 aa, Homo sapiens; identical to SEQ ID NO: 17072

SEQ ID NO: 17074 - protein, 83 aa, Homo sapiens
MAVSTEELEATVQEVLGRLKSHQFFQSTWDTVAFIVFLTFMGTVLLLLLLVVAHCCCCSSPGPRRESPRKERPKGVDNLALEP

SEQ ID NO: 17075 - protein, 204 aa, Homo sapiens
MQSALVGSWHNNGFYGHYRSQFKSESAREYHLAAKPQPPAVFLQRCQEPAQRHFFSKHDNRTSFDKGPYCLLQGIGRRKDLERLWQRHTFLRWAPCEIELRQQGPLESSYQADFRPGPGLSGLPQHLIHFVQVQPSHTRTTYQQNFCCPSQGGHYGSYKVGPQAPVTDVLPDLPGIPRPKLLQHYLHAGVSECLNWSRALNKDS

SEQ ID NO: 17076 - protein, 379 aa, Homo sapiens
MQSFLTLLKEHEDTCAPPAELVTLAGRLCRDFQDDLAQLQPLVTAILDSQLRLHLLDNADVALACARVLDQQEQQQAACRLLEGCQVPGGSQELVQLWNDIHYRLVMRRLGVAALTPVQKFRCRKRNPPPPSLCPEGLKSRNFPREVREKLHNFAVGVNTNPSKAERENLALETSLTPEQVYNWFANYRRRQRALPQHMKPAQQATAEDPGARERGPDLLQPSGNPRVDSGFVDRPQWSEEREEKGPPQSPQTTQGPWEPLALAPDFPADETVSKPLDVSGHPQSVQLEEGLGTSSGRTELRVGSFLVTQPPLQAPEFILTQSPPELAPAPSAFPGPVSAMELSQALPSSQVQCSDSQASGDAFWGARMLLEFSGSSLG

SEQ ID NO: 17077 - protein, 121 aa, Homo sapiens
MSLHGILASAGTIGAVAAWLMSYKPALFGFLFLLLLLSNWLVKYEHKLTLPEPQQDEILQRLLFSEMKMKVLENQMFIIWNKMNHHGRSSRHRNFPMKKHRMRRHESICPTLSDCTSSSPS

SEQ ID NO: 17078 - protein, 251 aa, Homo sapiens
MDTTLRMVRTACQHRAPQISHKTGCSHISMHSPGGLTTTKMAGPLPRVSDSLFSAMELAKMSDMTKLHQAVAAGDYSLVKKILKKGLCDPNYKDVDWNDRTPLHWAAIKGQMEVIRLLIEYGARPCLVTSVGWTPAHFAAEAGHLNILKTLHALHAAIDAPDFFGDTPKRIAQIYGQKACVAFLEKAEPECQDHRCAAQQKGLPLDERDEDWDAKKRELELSLPSLNQNMNKKNKKSRGPTRPSNTKGRRV

SEQ ID NO: 17079 - protein, 125 aa, Homo sapiens
MPPHPAIFFYCLLRQGLTMLPRLVLNFWAQAVHLPRPPRVLGLQAGGTAPGQKKLFLTSHFPPASPLPLCFSLQQNFKKHSPRSPPGILGSLYPGFCSPIATSPFAKGTRGLRVVGSSGRLSASS

SEQ ID NO: 17080 - protein, 129 aa, Homo sapiens
MAAATWDKESKCRLSRGHCHHRRHQSLPVGLTLRYSAPASHQPKCFTSKHGTRPSQRKPSLRVSGHYSPHSLFPGHGRRGACVARSRRFAGHMQLTWKLKRKKPGRTASSEEHKKQGRGCAGRRLIKST

SEQ ID NO: 17081 - protein, 236 aa, Homo sapiens
MHTYVYSYTRICIHMYIHIHAYAYICIFIYTHMHTYVYSYTRICIHMYIHIHAYAYIYVYSYTRICIHICIFIYTHMHTYMYIHIHAYAYIYVYSYTRICIHICVFICTHAYIYVYSYVQCMHMCIHMYTCMHMCIFICTHACICVFTSTHACICVFTCTHVYISVFTCTHVYICVFIYICIHVYIHIYICIHICVYSYIHMYTYIHTYTYTYTQLFFNHLSIDEHSLFLYLGYWE

SEQ ID NO: 17082 - protein, 149 aa, Homo sapiens
MRLLPRTSIPRRQPFSRWRKQNLKTPVSLNCSRSCKLLEGRGMPAIFIIALPPPNTIGGPALIISLQVYPAAPERQRPARRGHDDGGGFVKTKMGICREKKERSDCYCVYIEREDIRDSILKKTCTLNNCFAEMLLICSFAPATLPQPL

SEQ ID NO: 17083 - protein, 147 aa, Homo sapiens
MIYDGNNQLLNASKVGEVLRGGTRQIYYQVVNFSSLWPLYKYADKLHVILLYKTLHQLVVEPVKVAAWYYESARLLNTYGLLGMNVAGISWHLYIFHLVCTDTSVSSSAPLPCPLPLIHQMLIIFVWRLLRACLYCSSLALIIWSYS

SEQ ID NO: 17084 - protein, 413 aa, Homo sapiens
MRGGHSPAAAPAHTGGRRGGGAPAPQCVRSPAALSRRHQPGRLLLHVCSPVPWTGTATEGQSVGTCLPGQFTRPLDRHRHRGSECWHLSSGSVHPSPGPAPAQRVRVLAPVFRICSPLPRTGTATEGQECWHLSSGSVHPSPGPAPPQRVRSVGTCLPDLFTRPLDRHRHRGSECWHLSSGSVHPSPGPAPPQRVRVLAPVFRICSPVPWTGTATEGQSVGTCLPDLFTRPLDRHRHRGSECWHLSSGSVHPSPGSAPAQRVRVLAPVFRICSPVPWTGTATEGQSVGTCLPDLFTPRLDRHRHRGSECWHLSSGSVHPSPGPAPPQRVRVLAPVFRICSPLPWIGTGTEGQSVGTCLPDLFTRPLDRHRHRGSECWHLSSGSVHPSPGLAPAQRVECWHLSSGSPSLPLFVE

SEQ ID NO: 17085 - protein, 144 aa, Homo sapiens
MIRAALLEPQPPKLKQSSHLSPQGAGTTGAGPHTPLTFLYFFRLELLQAALPPQPPKVLVRQPGGKDSLAESPFDLSTGRNAPCGGALGNLRHLQWGGAWPLLFLGGTWDSVYQAGSTLALGRVSVSLFFFLPNKFHSHPSRHL

SEQ ID NO: 17086 - protein, 121 aa, Homo sapiens
MKGYRDNAVESTFTSRFYGSEKWLQITYLKTQMPSGSAGNIEDLTSFFIFLRQSLALLPRLECSGTISAHCNLSLPGSSISHASAFRVAGITGVHCRTQLIFVYLVETGFHHMLARMVSIS

SEQ ID NO: 17087 - protein, 132 aa, Homo sapiens
MLSPLWLQISKRPRPEVSVSNACFSSALPTSNPTSLTLKHHNIFVLRVALEIIQYSVHGGRNRKPLEVTSLAYSCPENWWQKQIGVQPPDVHASALSPKPCVSWSRPLSLLSSTILFWKTHDERADFSKLHS

SEQ ID NO: 17088 - protein, 154 aa, Homo sapiens
MEIMPMNIVSIISPLIDVSPGRRGRLKNAGGGIRLAERVNRRADRNVLRREKGLALGRVTFPRAGRGSRVSAPARSEPGPAAVPGGVRRADDRKFPPGASQPAFRSRRFQAAAGGPSYANDPTSSAKPVKLLPRERAGLKVTNFSQSREREGSA

SEQ ID NO: 17089 - protein, 128 aa, Homo sapiens
MSCHQSPLVFDVGQCRQHDLAGQILIYHSLTPAGPLGRPPDVPHSPHLASPTGSRQRTVGGTCDTALFLCSCFSSSFFSLLVTLFFFTLSPHKTRNFVILLIFLYSVCLHTDGYLRASELSLPPSIIS

SEQ ID NO: 17090 - protein, 137 aa, Homo sapiens
MLGVEDLVGAGRWGRGPENLPDSGGRLAEQALQGPSHPFSCLPPPEQILGAWRALKEELLSRAPSQFTLCTEVLQSSNLSPTPAVSPFVQSSVEMEKFLVPLSMFLSGERTWKLLLQVDFLNQGGEYYRNWRKRRRT

SEQ ID NO: 17091 - protein, 373 aa, Homo sapiens [sequence omitted]

SEQ ID NO: 17092 - protein, 1105 aa, Homo sapiens
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDPARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPTVPLKSRHLVAAATAQRPTHR

SEQ ID NO: 17093 - protein, 161 aa, Homo sapiens
MGHRPNLGQPPHPNAVAAALHASLCPANRGTCPLGKPGYPGCLWFQPLLLFPGCLCSPDGPFPRAVFTSAGKGPLQTDLGRGRVPPRDQQTPKSGPCPRAPVASNRQSGGSAVSAPLSGARRAWKSAFAAPPRSRLRPQKGVPWTEKRARGGGRAGPCRRT

SEQ ID NO: 17094 - protein, 123 aa, Homo sapiens
MRSEKSKGCWRDGGDAHPGEKASQSSGITGVSHRTRLTSVLLRNTQRRRHRRGEHHVMVDTEIGVLQPQAKELLEPPGDGRCKELIFSQSLWRECGPGDTLILDFWPTEPCTQEDFISQVSLQ

SEQ ID NO: 17095 - protein, 209 aa, Homo sapiens
MLSSQLCCVHSLPPTANPAALCSLAQQMFTNIRSPCSGPQGSPGLPRRTHIHLWPHSAHMYFLVTSSLLPFPLIQPGCSRTRFKTLCSLRHTSAPTEEGHGPVRRPCGMHCLSHLPHPRGRPQGHPTHMRPALQQALLSHPSLLLPWRSSPDSAVQVGPSMILRRIPMAGHLCFPHWPQLLDSRDCCTYTCINTPVLNSHMVQEGVCGQ

SEQ ID NO: 17096 - protein, 213 aa, Homo sapiens
MSPKCAETAQQLRCLTENVQRPLCPTMPAWGRPSLGLLRVSPACQPKGGRSCGCSQPLLKVGLWVEMWAASGRHSYKCIPALRTTFLLPSPFLRTPMQKRGRQLTKDREGYCSWHLMGSICCIPLGCCPGWIGKELAGRLSSVLTTWLGGGRGAWQEQSAGPGNWGLVHVCTHVCVCVRACWVGREEAVKPHPLLSAAVLLCVSAARGCHHTS

SEQ ID NO: 17097 - protein, 203 aa, Homo sapiens
MDSAPAGSFSASSFFDLSVTVTRAKNSRGPSSSPSELQGAHCLTSSLAAACSVAYSALWSSSPLRSPWSISSITMPRLSSEESSASLLAGADGRPPRLLFLPFWVNLLRLVLFLRPRRPLLGFLAAPRSEPACPVTSPESWACVSEAGGVGASPGVPASAACVGPSSSSRRLICLRTLVSCARSFHRTLQTPSLPGISLGMAA

SEQ ID NO: 17098 - protein, 221 aa, Homo sapiens
MAAAGPLCTERVSVLSQPNSGVEDPTPAGGRGQGRRRGREELESIGAGPGASVRILPALRPGLGGVWGAGAASLVFQAGPGSSWLGWPDLDLALYRGWACRSEGTANVAFPGTASPGFSRARQTRDLRKPALKTPSHTASQLAAEAGNPSGGCPSMRCQRRVGALVPTWKGGWRDGWSGSGGRAKERILAFSFPAGGGIRGERVQAASNTRIWEEPGSTPN

SEQ ID NO: 17099 - protein, 125 aa, Homo sapiens
MQPVISALNIQTQTVQTHPAPRNTSEHCTLPACDAQEEHRDTVDGSIARTESASGEIWRQTHMDGEHHVNTKAEISVMSANQGAPRITSKPPEARREARDRSLPSAFSLRGLTDTLILGFCPPEL

SEQ ID NO: 17100 - protein, 122 aa, Homo sapiens
MKVALLRFFSPPNMSVTHKEAHERKCPEKPELWKAGSTVPLTAPEKTDPFPLCPPLSLTCPQQQSCIPSSSQDVLNSLWVSSHCLQLKISKTKTHCLPTQNVLPFLLPTPVSIVCRLPGLDP

SEQ ID NO: 17101 - protein, 152 aa, Homo sapiens
MEAEAWGSQARAGLGAAENCLEGGNQAFLLERVTGTKGRGQGQPLERAGEEGEAGGDPRRDPGEVVAKSRVRARPHLSLYPALPGVALALLCCPLQDRCLRLVPACPTAGPQHPQVLPWALQKQGVVRSGPWATEEMVWGTRTGVGGLTAVF

SEQ ID NO: 17102 - protein, 292 aa, Homo sapiens
MQPSREALELRGLPKSVSTVSSTKPPLTTPSSTNPSRQLALEDCVQLRAALDLGYGPECCCHHLPEVAHKSSASAGAPSARLPLQPHSLGTRTKLPPSLCLPGPGRTRLTTEPFPGAPFCSDSCSPALCCVLLTPGRGRGSVAPLGSSQDGRGGCCPTDTVPAAQGMDASWTVAPAQEWLGHPLQSCPQSASRGHLPLPLPTPTTPCISQPPGRRCRPHCGKELFRAPGALHFLPRRHPAAVRHRWTRACPEGPRMHIPQGWLLSSPSLLTDWFSMDSFKPPSLASGQISKT

SEQ ID NO: 17103 - protein, 299 aa, Homo sapiens
MPEGSVSAMRTSPKSSWPWCCSWSCAWSSSSPPWRSPPSATGTLCRSCSLAPSGDLEVLKSQETGCRDPLQLPGLLGPCALSPMVGSPSGRVKLVGRRSVVQCSRCCIDPLIFFVFVFILFCFVFEMESCSVTQAGVQWCDDLGSLQPPPPGFSCLSLPGSWDYRHPPPHPANFCIFSRDEVSTPTQAGVKLLTASDLPTLASQSVAITGVSHHAQPNPLIFCFSSSTVRKAFDRGPRRWQHGGGLTVWVVVKALESQLQREDVDLRDGQCHLHRRLEAPAWGNLLGKEGSKRGTMKQN

SEQ ID NO: 17104 - protein, 280 aa, Homo sapiens
MTSLTHGMHLTSSTSCSCQSSGTSFTSCSCRSSGTSSTSRSWWSSGTSSTSCSWWSSGTSSTFCSCWSSGTSFTSCSCWSSGTSSTPCSCRSSGTSSTSCSCWSSGTSSTSWSCKSSGTSSTCYMCLSSGTSSTSYSSWSSQTSSTSSMCLPSRTSSIFYSCLPLGHHLPFCSVRPLGPPTTSPLSNLWILSHPFYLGGVWPLNNHLHMNLLGYFNNLHLWSLGLQPLPPPGSPLVHLPPPPLGWPLLSELLQDLNQLPYPLLPVGPRPRPPHVLLGIFI

SEQ ID NO: 17105 - protein, 158 aa, Homo sapiens
MLDGGRNGRLLELSSLLPERGGGPSLCRSPASTEKEVGACGTLASLRRGLWKCSLCPGPALLLGGSCCLICSLSLLLLSTPTFFSRNFEPSFSPSPIEKPSAPSSGQSSQLQTQVQPPAERGAASMPGPASLPLSTGPSQPLRCSPRVLCSRVLALRR

SEQ ID NO: 17106 - protein, 159 aa, Homo sapiens
MATVDPAGLALHPACPRVWGPSDQHRPPQEGSHLPARRRGLARNQSCQHPDLGPPASRTEKEMSAVAAPGCAALLQPPQQTSVQSFKGMSLSVEAGLCGEPAGKLLGEGGGQREASLVGKKGWEWRRHRGRTLSEEDQGARPFSPGSCALRGDREGGIG

SEQ ID NO: 17107 - protein, 205 aa, Homo sapiens
MREPLIPPCKAASLSEQEQVRGECGMMTAQGILGPRGKSKLPVLPDPRLICRYMCSCREIPGVISTPVPHSAGPQVTRFHSPSPPHISELSQTLHAPFQGSWPRPCHALSGPRAMVPNQLHPGTPCPAHVPHSCTMPAGTCPLFTGAPAAAEAGLNPGPALRAPTSCSSSTWPKPFMTVCLLPTSSMLTSPGTGGCIRARILEPA

SEQ ID NO: 17108 - protein, 150 aa, Homo sapiens
MAVTFQMLAVQQSTSHAIQSWHSLRPSCQRRPDSSCTRLSGMTSAATRTSETAMDATRLWGTRWKVRTRRMVASTSRFQANVAATRKPSKAAGCSLNSVLGKPVLGEPAFWDLPSVPVAPATPSEAAAPESECWRAHRDLPYPSGDLALQ

SEQ ID NO: 17109 - protein, 175 aa, Homo sapiens
MTRPLPESIRLLRHTGLVPPTPVPLGYPHQSFVSQPHPFSKQPSPCPRQSPQGDFGWVSPGASRSITGPSSPAAPSLISLGSLGSHLQGARPHPRQSSLGDFGLVTPGTPCCRLCPPLLLPQGRPPWVLCAGVSKELGPNPVLPSPIVEQRLGHGADMVPPPDQEEWNVVMSQST

SEQ ID NO: 17110 - protein, 175 aa, Homo sapiens; identical to SEQ ID NO: 17109

SEQ ID NO: 17111 - protein, 196 aa, Homo sapiens
MAAASVPPESSIIHPASSAIKRTDGGRLELEIRIGIFAQFWSACLLFPRCSQPRQPRSWGPRVNAFALWPATRRPAHTGRRVTPARACSHTSGTGAGRKRKGGETSFQREWSENRREKGQGKIRSPAPEPAGGEASSSPAPEERGPSHCSQANVSPASCTLPGKTRIHSLCREGNAGRTPSQPPLSGYKTPNKRNL

SEQ ID NO: 17112 - protein, 140 aa, Homo sapiens
MGLEAKNSPCCHQHGDFVPYPILSARVFQPEVEEATLAAHAISHDCVCSGGGVLLPHDWRNNYMILLNPQVLADERGHQRPVAFLAYKVNGQYIMEGFASSFLFTMGGLGFIMLDQSNAPNIPKLNRFFFFYSLDSSVSY

SEQ ID NO: 17113 - protein, 153 aa, Homo sapiens
MHLKNPPNPPHLPPVESARNKTILLQQLSALPDSPLWGLGMTRVFLADLTEASLALCSLISLKCLPGDSGKSGKVSLGLAGCSGIQTSVAPSSQQQKTASCGTGGRCCGPHPASPRKGAGSHSTARAWPSKGEAQLFSPPASAGCSGTQPGVT

SEQ ID NO: 17114 - protein, 182 aa, Homo sapiens
MAVTGVQCSERCKQTRRVDSSSGKWLATPLIWEKLNWPSRSQSQNLHPFRILPNGLTLPGAQERPGYLLAALPNPCAPRPYQVHWVHVAVLIAVLLQQLPQSRCLRLPLPGGGGGQRALQGRLKTQAGKRGVRKRGGWRERERPSADPGERGLRVGAQVQNPRAPRKIFAIPATSKVQLRPM

SEQ ID NO: 17115 - protein, 144 aa, Homo sapiens
MADGGGGGSGGAGPASTRASRGLFDSFRRDCKADVDTKPAYQNLSQKADNFVSTHLDKQEWNPPANDNQLHDGLRQSVVQSGRSEAGVDRISSQVVDPKLNHIFRPQIEQIIHEFLVAQKEAAVPALPPEPEGQDPPAPSQDTS

SEQ ID NO: 17116 - protein, 286 aa, Homo sapiens
QRCCRCCCRCPCCGQGPRSGCKIPAGDARVRDGAGGSVHLCALFGLLPRVWLERFYPCLWPLVPGRGQCRPGDSATNNSTQKVQKETQGRFHLLGDPSRNNCSLSIRDARRRDNGSYFFWVARGRTKFSYKYSPLSVYVTALTHRPDILIPEFLKSGHPSNLTCSVPWVCEQGTPPIFSWMSAAPTSLGPRTLHSSVLTIIPRPQDHGTNLICQVTFPGAGVTTERTIQLSVSWKSGTVEEVVVLAVGVVAVKILLLCLCLIILSFHKKKAVRAVEVEENVYAVMG

SEQ ID NO: 17117 - protein, 277 aa, Homo sapiens
MPESVTVQEGLCIFVHCSVFYLEYGWKDSTPAYGHWFREGVSVDQETPVATNNSTQKVQKETQGRFHLLGDPSRNNCSLSIRDARRRDNGSYFFWVARGRTKFSYKYSPLSVYVTALTHRPDILIPEFLKSGHPSNLTCSVPWVCEQGTPPIFSWMSAAPTSLGPRTLHSSVLTIIPRPQDHGTNLICQVTFPGAGVTTERTIQLSVSYPLMNPVIEASLEDGTGKSGTVEEVVVLAVGVVAVKILLLCLCLIILSFHKKKAVRAVEVEENVYAVMG

SEQ ID NO: 17118 - protein, 180 aa, Homo sapiens
MAESLPLEMLTYILSFLPLSDQKEASLVSWAWYRAAQNALRESLGLRGICCISLTNLDGSLASHQVLQSVAYHLGPHLQSLSLGGGSPTEASSVALILGCPALCVLDLSGCNSLFTSGTLLAQPEMAQSVQQALSGLRELNLAGLRDLADLSFNQLSSCAPSLERLSLAYCHLTFELGPA

SEQ ID NO: 17119 - protein, 233 aa, Homo sapiens
MRLLPLLRTVLWAAFLGSPLRGGSSLRHVVYWNSSNPSLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 17120 - protein, 164 aa, Homo sapiens
MEDERILDNLGAEGRHGSEWEWRRWHFGGWVEEEHRHRWPRGVWSTDKSPGGVQPQCLSQEVSALVSGTQSSLRNGLGDKWSACCTRALGQMEQTKQSKRRAGREDRFSVALGRCRGNEHKTLSHVPGASDAAQKPRAKPCSRGIGASVLLQTMHLSFITLGFR

SEQ ID NO: 17121 - protein, 440 aa, Homo sapiens
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKSWKALTLSQKRPYVDEAERLRLQHMQDYPNYKYRPRRKKQAKRLCKRVDPGFLLSSLSRDQNALPEKRSGSRGALGEKEDRGEYSPGTALPSLRGCYHEGPAGGGGGGTPSSVDTYPYGLPTPPEMSPLDVLEPEQTFFSSPCQEEHGHPRRIPHLPGHPYSPEYAPSPLHCSHPLGSLALGQSPGVSMMSPVPGCPPSPAYYSPATYHPLHSNLQAHLGQLSPPPEHPGFDALDQLSQVELLGDMDRNEFDQYLNTPGHPDSATGAMALSGHVPVSQVTPTGPTETSLISVLADATATYYNSYSVS

SEQ ID NO: 17122 - protein, 295 aa, Homo sapiens
MLPDFKLYYKATVTKTAWYRYQNRDIDQWNRTEPSEITPHIYNYLIFDKPEKNKQWGKDSLFNKWCWENWLAICRKLKLDPFLTPYTKINSRWIKYLNVRPKTIKTVEENLGITIQDIGMGKDFMSKTPKAMATKAKIDKWDLIKLKSFCTAKETTIRVNRQPTKWEKIFATYSSDKGLISRIYNEFKQIYKKKTNNPIKKWAKDMNRHFSKEDIYAAKKHMKKCSPSLAIREMQIKTTMRYHLTPVRMAVIKKSGNNRCWRGCGEIGTLLHCWWDCKLVQPLWKSVWRFLRDLE

SEQ ID NO: 17123 - protein, 123 aa, Homo sapiens
MQSEKPQGLFLQLNPNASSTETQLLVPALESRDTLPPTHCFMAGTESPLGNPWPLSLPPPCWTGCLLPAPRGQRKPGPLGLSIFISLGNKRHRSGNHVVRESEQPLSQGNPHQGWGPDTRKGR

SEQ ID NO: 17124 - protein, 123 aa, Homo sapiens; identical to SEQ ID NO: 17123

SEQ ID NO: 17125 - protein, 284 aa, Homo sapiens
MLSVVENGLDPQAAIPVIKKKLVGSVKALQKQYVSLDMVVTSEDGDANTMCSALEAVFIHGLHTKHIRAEAGGKRKKSAHQKPLPQPVFWPLLKAVTPKHIISELEHLTFVNMDVGRCRAWLRLALNNGLMECYLKLLLQEQARLQLQRKESLDSISHSSGSEDIEVHHSGHKIRRNQKPTASSLSLDTASSSQLSCSLNSDSCLLQENGSKSPDHCEEPMSYDSDLGTANAEDSDQSLQDIKIFSWAQWLTPVIPALWEAEAGGSQSQEIETFLANTVKPHLY

SEQ ID NO: 17126 - protein, 171 aa, Homo sapiens
MDWTPRLPSRHIISELEHLTFVNMDVGRCRAWLRLALNNGLMECYLKLLLQEQARLQLQRKESLDSISHSSGSEDIEVHHSGHKIRRNQKPTASSLSLDTASSSQLSCSLNSDSCLLQENGSKSPDHCEEPMSYDSDLGTANAEDSDQSLQEKTRAGSQRMTSTGLPGSNP

SEQ ID NO: 17127 - protein, 191 aa, Homo sapiens [sequence omitted]

SEQ ID NO: 17128 - protein, 1365 aa, Homo sapiens
MSSGRRRGSAPWHSFSRFFAPRSPSRDKEEEEEERPGTSPPPAPGRSAASVENEPMSTSQKKENVLSSEAVKIRQSEDKRNHAEKPVTLPVQEDPKKAYDLSSSTSDTKIGESDRQPKESFFQFLGNLFNISGKSSLGEAKQSSFKDDQDKTEKDLQNPSDHHEDGIKREREIFSGSLRTQTHPTEEQDSNSSELSDAFSLDTTQDSDQETTNLLKQIDGKPEKPSVTYATYRGPRHIGKYLKQQTGLATVNTLDRENESSDSSTNRHIDPGSEIEAGVLPLLLSASTDSSMKGNLLEGPLEDSDCSKTSFNKENSLTNNPELQNIASSNNLLNKNAWGSIERNRSSPSSVTNSSYDGESDSQHHLSCEPVSQTNRNLVCSALLTGSNHRKVPCSPDFQRVTTTENTIKENSTVMSNRTLVQREELVEPQGPAISDFSCSKSDGSDTTEQESTNLPSPNKSIRHEHLQLPESECSDKQTIDSSSKQAATHTNIIALQRHAVTDTEFVNEGKRLSAQDSQKNVAVREIRRETESASAGESIASSHVKAPEDKIESLPKDTDQYFETKAKKLDFRSHDKIPHIRMNKKDLASLNYISESAVVASLGNENAPELKFELNRSHISETPLDSESPQQAEVSPDAKTSLSLDCKKLNFSISPPTFVSGVGMLSKLDIPDLMNEGSPVPIETGNVNIVGISYQPRKCKEENVKNHVEAAGRKSPPPSFCLEYTSAIFEFKEVLSNSEKCQVLPGSEASGPHLTGLELLSFDSGNLSKDCSSILSQDPNRVELVSSNTKANMSIIEKSDSLSLEAKTANIVSKAEIDGQNNVLVESHSGRGKTISLSKVSLSKVEPRNISQDKMSSFPLKITHVPEKPILSELTFLEVEQGKRFQSINHNEIGEKCSDAGLKENCQAELSPAASKYEDKPEPEVDALGSPPALLKSNISWILPPIHDEKISRQMAQNCEAHTCVFHQSLDICGTKKISGHSEMAELSLTNISPKFQETGSMKVNSPFLDSDSSLEKNSSASEDSSFLKVPSVLKLEKKSSSYRKKENIHFLNGGIDSVSSSSSYPEEVSMIVNSHKPQNNLDSIQVTKDLTHEGTSVTNLLYPTTSYLEFETSVSIGTEVTPFQEHFGIYTGKISIDFPTAAQFDNLVEAETGAVAGPAASVNSSGQQCSEASAEHIEARRRAHDQLLDLKSSLLKKADTLIGEIFNSVREELKFKHTVSTCQEHIAIEGIMNLGTLKEDISEKNPSEVTLTEIQQTEGLEEQGMENMSEVKEKPCVSPTVGEKNLLVDPNSMNVSCLLEDKARELVNEIIYVAQEKLRNDTFEDTEDTWDSELQANTSKILNSDSVKPHDVVREFLVSEQPV

SEQ ID NO: 17129 - protein, 123 aa, Homo sapiens
MATHRSTLAGYSPCSSPQRAAPTRNQKAEKARNRQASPIPTRLPRNPSLASTGRQGTPMSRKKQGSDCLVYPGHPPGLWPVISCHLGLSALSSEIWTSNCLCLAALPCDTGLESLTVVCWSGI

SEQ ID NO: 17130 - protein, 124 aa, Homo sapiens
MVRATRGYWEAKGKWQTWLRFRKKSSKCREARTFPSFKFLKGSQSSFSSLLQMPLQSFTAAHTYRRRNSPSQKDDRALGAGVPLVLAESLDACEVKPDLGKAALWTLLAVPHTQLGFLRKQHRL

SEQ ID NO: 17131 - protein, 133 aa, Homo sapiens
MGWPLSLSPSGFREVEWGILFVWQWLLSSWHLSPFPVPTSPSTPCLPFLCHPLPVLHGNCTGLSVFACMCAPVYTCIERYICGGRGERGGGGVKLRACSQDTAHWSLSSAPSVLVRLREEGGRALVKPDCPSL

SEQ ID NO: 17132 - protein, 177 aa, Homo sapiens
MTTSIRQFTSSSSIKGSSGLGGGSSRTSCQLSGGLGAGSCRPGSAGGLGSALGGSSYSSCYSFGSGGGYGSSSFEGVDGLLVGGEKATMQNLNDRLASYLDKVRALEEADTELEVKIRDWYQRQAPGPARDYSQYYRIIEELQNKPPWTMPTSCYRMTMPIWLLLTSAPKSWQNEGR

SEQ ID NO: 17133 - protein, 326 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDG

SEQ ID NO: 17134 - protein, 1063 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALQATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 17135 - protein, 115 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYP

SEQ ID NO: 17136 - protein, 923 aa, Homo sapiens
MCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGTAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 17137 - protein, 1093 aa, Homo sapiens
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALQATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 17138 - protein, 923 aa, Homo sapiens [sequence omitted]

SEQ ID NO: 17139 - protein, 257 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRVFYHGCWLLSGCD

SEQ ID NO: 17140 - protein, 212 aa, Homo sapiens
MPTTCHCVAITPPDSGGSPSSPAGGSPSPAPAAGAAELSPATPTGSANPTTSSCAGGTPAASLLRWVRSCFLRLDDTTKDFPHALQWKGRSPECTRLCFVRLARSAKARPHSSQRKGRWPECTSACRLRSQDATNVLSHCRHLNGRSPVCTRRCMARSAGCRKSLPHFSQWYGFTPSWARWWRRKLEGSENMRPQRGHRKGFSPECVRSWLW

SEQ ID NO: 17141 - protein, 410 aa, Homo sapiens
MGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQRQINHPFVHSLGDSWQGKRHLFIMCSYCSTDLYSLWSAVGCFPEASIRLFAAELVLVLCYLHDLGIMHRDVKMENILLDERGHLKLTDFGLSRHVPQGAQAYTICGTLQYMAPEVLSGGPYNHAADWWSLGVLLFSLATGKFPVAAERDHVAMLASVTHSDSEIPASLNQGLSLLLHELLCQNPLHRLRYLHHFQVHPFFRGVAFDPELLQKQPVNFVTETQATQPSSAETMPFDDFDCDLESFLLYPIPA

SEQ ID NO: 17142 - protein, 148 aa, Homo sapiens [sequence omitted]

SEQ ID NO: 17143 - protein, 171 aa, Homo sapiens
MGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQVISMTWASCIEM

SEQ ID NO: 17144 - protein, 171 aa, Homo sapiens; identical to SEQ ID NO: 17143

SEQ ID NO: 17145 - protein, 146 aa, Homo sapiens
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTAEAEPEMDVRKRTPCHTH

SEQ ID NO: 17146 - protein, 259 aa, Homo sapiens
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTAEAEPEMDVRKRTGVAGSQPVSEKQLAAELDLVLQRHQNLQEKLAEEMLGLARSLKTNTLAAQSVIKKDNQTLSHSLKMADQNLEKLKTESERLEQHTQKSVNWLLWAMLIIVCFIFISMILFIRIMPKLK

SEQ ID NO: 17147 - protein, 886 aa, Homo sapiens
MRPDCNSQKPSQALSIRDTSSKDPWPDIEPQLPATPAAVWGVFTFSWRGAGALGPRRGPRRLNNKRGAAKRQEDKTMSKGPGPGGSAASSAPPAATAQVLQAQPEKPQHYTYLKEFRTEQCPLFVQHKCTQHRPYTCFHWHFVNQRRRRSIRRRDGTFNYSPDVYCTKYDEATGLCPEGDECPFLHRTTGDTERRYHLRYYKTGICIHETDSKGNCTKNGLHCAFAHGPHDLRSPVYDIRELQAMEALQNGQTTVEGSIEGQSAGAASHAMIEKILSEEPRWQETAYVLGNYKTEPCKKPPRLCRQGYACPYYHNSKDRRRSPRKHKYRSSPCPNVKHGDEWGDPGKCENGDACQYCHTRTEQQFHPEIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPICQPGRAHTLQS

SEQ ID NO: 17148 - protein, 169 aa, Homo sapiens
MVSSKGLWKERPSAHTSECFSTTACPVAFILLVWNSQTPAGLQSLCTGRHPSLSARAQRAGPRASREEGTFWTERVGQERWLIRSGSSQNESQEDQGAGLISQAGLKADNRRESSTWANEVEDRRPQCTPALNLTPSHPHPPHSLTTFLRSVIGIQIPPGLVAAGGTVA

SEQ ID NO: 17149 - protein, 169 aa, Homo sapiens
MGSSKGLWKEKPSAHTSECFSTTACPVACILLVWNSQTPAGLQSLCTGRHPSLSARAQWAGPRASREEGTFWTEPVGQERRLIRSGSSQNESQEDQGADLISHEGLKADNQRESSTWANEVEDRRPQCTSALNLTPSHLHPPHPLTTFFRNVIGIKIPPGLVAMGGTVA

SEQ ID NO: 17150 - protein, 323 aa, Homo sapiens
MKNVDSDDLVTGTLPKLKSSKEWLEPKPLCFMEVLAKEDTEAAIQSILYKENSVIKELDKYLQHHAFLNARRKEMLYKRWVDCVADPLQKKIIEKVCSHKKIKKRRQGELDGFLKHVNKKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLQEREEDQDGSPSPRLGLLKLEL

SEQ ID NO: 17151 - protein, 863 aa, Homo sapiens
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIEIGSCYVAQVDLELLASNDPPTSTS

SEQ ID NO: 17152 - protein, 3997 aa, Homo sapiens
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIGVKSKNPLPTLEGSIQNVELKYCSTSLVKCASGTMGSIKICAKAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGHKYMEPLQEIPFVIPRPILEEGDAFPWTISLHNFSIYTLLGKQVTLCLVEPMGCTSTLAVTSQKLLATGPDTRHSFVVCLHVDLESLEIKCSNPQVQLFYELTDIMNKVWNKIQKRGNLNLSPTSPETMAGPVPTSPVRSSIGTAPPDTSTCSPSADIGTTTEGDSIQAGEESPFSDSVTLEQTTSNIGGTSGRVSLWMQWVLPKITIKLFAPDPENKGTEVCMVSELEDLSASIDVQDVYTKVKCKIESFNIDHYRSRPGEGWQSGHFEGVFLQCKEKSVTTTKLLDGTHQQHGFLSLTYTKAVTKNVRHKLTSRNERRSFHKLSEGLMDGSPHFLHEILLSAQAFDIVLYFPLLNAIASIFQAKLPKTQKEKRKSPGQPMRTHTLTSRNLPLIYVNTSVIRIFIPKTEEMQPTVEANQAAKEDTVVLKIGSVAMAPQADNPLGRSVLRKDIYQRALNLGILRDPGSEIEDRQYQIDLQSINIGTAQWHQLKPEKESVSGGVVTETERNSQNPALEWNMASSIRRHQERRAILTPVLTDFSVRITGAPAVIFTKVVSPENLHTEEILVCGHSLEVNITTNLDFFLSVAQVQLLHQLIVANMTGLEPSNKAAEISKQEQKKVDIFDGGMAETSSRYSGAQDSGIGSDSVKIRIVQIEQHSGASQHRIARPSRQSSIVKNLNFIPFDIFITASRISLMTYSCMALSKSKSQEQKNNEKTDKSSLNLPEVDSDVAKPNQACISTVTAEDLLRSSISFPSGKKIGVLSLESLHASTRSSARQALGITIVRQPGRRGTGDLQLEPFLYFIVSQPSLLLSCHHRKQRVEVSIFDAVLKGVASDYKCIDPGKTLPEALDYCTVWLQTVPGEIDSKSGIPPSFITLQIKDFLNGPADVNLDISKPLKANLSFTKLDQINLFLKKIKNAHSLAHSEETSAMSNTMVNKDDLPVSKYYRGKLSKPKIHGDGVQKISAQENMWRAVSCFQKISVQTTQIVISMETVPHTSKPCLLASLSNLNGSLSVKATQKVPGIILGSSFLLSINDFLLKTSLKERSRILIGPCCATANLEAKWCKHSGNPGPEQSIPKISIDLRGGLLQVFWGQEHLNCLVLLHELLNGYLNEEGNFEVQVSEPVPQMSSPVEKNQTFKSEQSSDDLRTGLFQYVQDAESLKLPGVYEVLFYNETEDCPGMMLWRYPEPRVLTLVRITPVPFNTTEDPDISTADLGDVLQVPCSLEYWDELQKVFVAFREFNLSESKVCELQLPDINLVNDQKKLVSSDLWRIVLNSSQNGADDQSSASESGSQSTCDPLVTPTALAACTRVDSCFTPWFVPSLCVSFQFAHLEFHLCHHLDQLGTAAPQYLQPFVSDRNMPSELEYMIVSFREPHMYLRQWNNGSVCQEIQFLAQADCKLLECRNVTMQSVVKPFSIFGQMAVSSDVVEKLLDCTVIVDSVFVNLGQHVVHSLNTAIQAWQQNKCPEVEELVFSHFVICNDTQETLRFGQVDTDENILLASLHSHQYSWRSHKSPQLLHICIEGWGNWRWSEPFSVDHAGTFIRTIQYRGRTASLIIKVQQLNGVQKQIIICGRQIICSYLSQSIELKVVQHYIGQDGQAVVREHFDCLTAKQKLPSYILENNELTELCVKAKGDEDWSRDVCLESKAPEYSIVIQVPSSNSSIIYVWCTVLTLEPNSQVQQRMIVFSPLFIMRSHLPDPIIIHLEKRSLGLSETQIIPGKGQEKPLQNIEPDLVHHLTFQAREEYDPSDCAVPISTSLIKQIATKVHPGGTVNQILDEFYGPEKSLQPIWPYNKKDSDRNEQLSQWDSPMRVKLSIWKPYVRTLLIELLPWALLINESKWDLWLFEGEKIVLQVPAGKIIIPPNFQEAFQIGIYWANTNTVHKSVAIKLVHNLTSPKWKDGGNGEVVTLDEEAFVDTEIRLGAFPGHQKLCQFCISSMVQQGIQIIQIEDKTTIINNTPYQIFYKPQLSVCNPHSGKEYFRVPDSATFSICPGGEQPAMKSSSLPCWDLMPDISQSVLDASLLQKQIMLGFSPAPGADSSQCWSLPAIVRPEFPRQSVAVPLGNFRENGFCTRAIVLTYQEHLGVTYLTLSEDPSPRVIIHNRCPVKMLIKENIKDIPKFEVYCKKIPSECSIHHELYHQISSYPDCKTKDLLPSLLLRVEPLDEVTTEWSDAIDINSQGTQVVFLTGFGYVYVDVVHQCGTVFITVAPEGKAGPILTNTNRAPEKIVTFKMFITQLSLAVFDDLTHHKASAELLRLTLDNIFLCVAPGAGPLPGEEPVAALFELYCVEICCGDLQLDNQLYNKSNFHFAVLVCQGEKAEPIQCSKMQSLLISNKELEEYKEKCFIKLCITLNEGKSILCDINEFSFELKPARLYVEDTFVYYIKTLFDTYLPNSRLAGHSTHLSGGKQVLPMQVTQHARALVNPVKLRKLVIQPVNLLVSIHASLKLYIASDHTPLSFSVFERGPIFTTARQLVHALAMHYAAGALFRAGWVVGSLDILGSPASLVRSIGNGVADFFRLPYEGLTRGPGAFVSGVSRGTTSFVKHISKGTLTSITNLATSLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVDGVRERLSEQQYNRLVDYITKTSCHLAPSCSSMQIPCPVVAAEPPPSTVKTYHYLVDPHFAQVFLSKFTMVKNKALRKGFP

SEQ ID NO: 17153 - protein, 4022 aa, Homo sapiens
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIGVKSKNPLPTLEGSIQNVELKYCSTSLVKCASGTMGSIKICAKAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGHKYMEPLQEIPFVIPRPILEEGDAFPWTISLHNFSIYTLLGKQVTLCLVEPMGCTSTLAVTSQKLLATGPDTRHSFVVCLHVDLESLEIKCSNPQVQLFYELTDIMNKVWNKIQKRGNLNLSPTSPETMAGPVPTSPVRSSIGTAPPDTSTCSPSADIGTTTEGDSIQAGEESPFSDSVTLEQTTSNIGGTSGRVSLWMQWVLPKITIKLFAPDPENKGTEVCMVSELEDLSASIDVQDVYTKVKCKIESFNIDHYRSSLGEECWSLGQCGGVFLSCTDKLNRRTLLVRPISKQDPFSNCSGFFPSTTTKLLDGTHQQHGFLSLTYTKAVTKNVRHKLTSRNERRSFHKLSEGLMDGSPHFLHEILLSAQAFDIVLYFPLLNAIASIFQAKLPKTQKEKRKSPGQPMRTHTLTSRNLPLIYVNTSVIRIFIPKTEEMQPTVEANQAAKEDTVVLKIGSVAMAPQADNPLGRSVLRKDIYQRALNLGILRDPGSEIEDRQYQIDLQSINIGTAQWHQLKPEKESVSGGVVTETERNSQNPALEWNMASSIRRHQERRAILTPVLTDFSVRITGAPAVIFTKVVSPENLHTEEILVCGHSLEVNITTNLDFFLSVAQVQLLHQLIVANMTGLEPSNKAAEISKQEQKKVDIFDGGMAETSSRYSGAQDSGIGSDSVKIRIVQIEQHSGASQHRIARPSRQSSIVKNLNFIPFDIFITASRISLMTYSCMALSKSKSQEQKNNEKTDKSSLNLPEVDSDVAKPNQACISTVTAEDLLRSSISFPSGKKIGVLSLESLHASTRSSARQALGITIVRQPGRRGTGDLQLEPFLYFIVSQPSLLLSCHHRKQRVEVSIFDAVLKGVASDYKCIDPGKTLPEALDYCTVWLQTVPGEIDSKSGIPPSFITLQIKDFLNGPADVNLDISKPLKANLSFTKLDQINLFLKKIKNAHSLAHSEETSAMSNTMVNKDDLPVSKYYRGKLSKPKIHGDGVQKISAQENMWRAVSCFQKISVQTTQIVISMETVPHTSKPCLLASLSNLNGSLSVKATQKVPGIILGSSFLLSINDFLLKTSLKERSRILIGPCCATANLEAKWCKHSGNPGPEQSIPKISIDLRGGLLQVFWGQEHLNCLVLLHELLNGYLNEEGNFEVQVSEPVPQMSSPVEKNQTFKSEQSSDDLRTGLFQYVQDAESLKLPGVYEVLFYNETEDCPGMMLWRYPEPRVLTLVRITPVPFNTTEDPDISTADLGDVLQVPCSLEYWDELQKVFVAFREFNLSESKVCELQLPDINLVNDQKKLVSSDLWRIVLNSSQNGADDQSSASESGSQSTCDPLVTPTALAACTRVDSCFTPWFVPSLCVSFQFAHLEFHLCHHLDQLGTAAPQYLQPFVSDRNMPSELEYMIVSFREPHMYLRQWNNGSVCQEIQFLAQADCKLLECRNVTMQSVVKPFSIFGQMAVSSDVVEKLLDCTVIVDSVFVNLGQHVVHSLNTAIQAWQQNKCPEVEELVFSHFVICNDTQETLRFGQVDTDENILLASLHSHQYSWRSHKSPQLLHICIEGWGNWRWSEPFSVDHAGTFIRTIQYRGRTASLIIKVQQLNGVQKQIIICGRQIICSYLSQSIELKVVQHYIGQDGQAVVREHFDCLTAKQKLPSYILENNELTELCVKAKGDEDWSRDVCLESKAPEYSIVIQVPSSNSSIIYVWCTVLTLEPNSQVQQRMIVFSPLFIMRSHLPDPIIIHLEKRSLGLSETQIIPGKGQEKPLQNIEPDLVHHLTFQAREEYDPSDCAVPISTSLIKQIATKVHPGGTVNQILDEFYGPEKSLQPIWPYNKKDSDRNEQLSQWDSPMRVKLSIWKPYVRTLLIELLPWALLINESKWDLWLFEGEKIVLQVPAGKIIIPPNFQEAFQIGIYWANTNTVHKSVAIKLVHNLTSPKWKDGGNGEVVTLDEEAFVDTEIRLGAFPGHQKLCQFCISSMVQQGIQIIQIEDKTTIINNTPYQIFYKPQLSVCNPHSGKEYFRVPDSATFSICPGGEQPAMKSSSLPCWDLMPDISQSVLDASLLQKQIMLGFSPAPGADSSQCWSLPAIVRPEFPRQSVAVPLGNFRENGFCTRAIVLTYQEHLGVTYLTLSEDPSPRVIIHNRCPVKMLIKENIKDIPKFEVYCKKIPSECSIHHELYHQISSYPDCKTKDLLPSLLLRVEPLDEVTTEWSDAIDINSQGTQVVFLTGFGYVYVDVVHQCGTVFITVAPEGKAGPILTNTNRAPEKIVTFKMFITQLSLAVFDDLTHHKASAELLRLTLDNIFLCVAPGAGPLPGEEPVAALFELYCVEICCGDLQLDNQLYNKSNFHFAVLVCQGEKAEPIQCSKMQSLLISNKELEEYKEKCFIKLCITLNEGKSILCDINEFSFELKPARLYVEDTFVYYIKTLFDTYLPNSRLAGHSTHLSGGKQVLPMQVTQHARALVNPVKLRKLVIQPVNLLVSIHASLKLYIASDHTPLSFSVFERGPIFTTARQLVHALAMHYAAGALFRAGWVVGSLDILGSPASLVRSIGNGVADFFRLPYEGLTRGPGAFVSGVSRGTTSFVKHISKGTLTSITNLATSLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVDGVRERLSEQQYNRLVDYITKTSCHLAPSCSSMQIPCPVVAAEPPPSTVKTYHYLVDPHFAQVFLSKFTMVKNKALRKGFP

SEQ ID NO: 17154 - protein, 1427 aa, Homo sapiens
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIGVKSKNPLPTLEGSIQNVELKYCSTSLVKCASGTMGSIKICAKAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGHKYMEPLQEIPFVIPRPILEEGDAFPWTISLHNFSIYTLLGKQVTLCLVEPMGCTSTLAVTSQKLLATGPDTRHSFVVCLHVDLESLEIKCSNPQVQLFYELTDIMNKVWNKIQKRGNLNLSPTSPETMAGPVPTSPVRSSIGTAPPDTSTCSPSADIGTTTEGDSIQAGEESPFSDSVTLEQTTSNIGGTSGRVSLWMQWVLPKITIKLFAPDPENKGTEVCMVSELEDLSASIDVQDVYTKVKCKIESFNIDHYRSRPGEGWQSGHFEGVFLQCKEKSVPWGRVLVFGAMWRCLPFLY

SEQ ID NO: 17155 - protein, 415 aa, Homo sapiens
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKVGLFSCCLYLYQL

SEQ ID NO: 17156 - protein, 3710 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 17157 - protein, 3753 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 17158 - protein, 3628 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLEQELEIQE

SEQ ID NO: 17159 - protein, 3585 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLEQELEIQE

SEQ ID NO: 17160 - protein, 4363 aa, Homo sapiens
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKNDRQQKGESYWYSVTASVVTRIVENIELKIQDVHLRFEDGVTNPSHPFAFGICIKNVSMQNAVNEPVQKLMRKKQLDVAEFSIYWDVDCTLLGDLPQMELQEAMARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAASRLHPPRLKLEAKAKPRLDINITSVLIDQYVSTKESWMADYCKDDKDIESAKSEDWMGSSVDPPCFGQTEVKTPKRRQPFVPFALRNHTGCTLWFATLTTTPTRAALSHSGSPGVVPEGNGTFLDDTHNVSEWREVLTGEEIPFEFEARGKLRHRHTHDLRIHQLQVRVNGWEQVSPVSVDKVGTFFRYAAPDKNSSSSTIGSPSSRTNIIHPQVYFSSLPPVRVVFAVTMEGSARKVITVRSALIVRNRLETPMELRLDSPSAPDKPVVLPAIMPGDSFAVPLHLTSWRLQARPKGLGVFFCKAPIHWTNVVKTAEISSSKRECHSMDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 17161 - protein, 4388 aa, Homo sapiens
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKNDRQQKGESYWYSVTASVVTRIVENIELKIQDVHLRFEDGVTNPSHPFAFGICIKNVSMQNAVNEPVQKLMRKKQLDVAEFSIYWDVDCTLLGDLPQMELQEAMARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAASRLHPPRLKLEAKAKPRLDINITSVLIDQYVSTKESWMADYCKDDKDIESAKSEDWMGSSVDPPCFGQSLPLVYLRTRSTASLTNLEHQIYARAEVKTPKRRQPFVPFALRNHTGCTLWFATLTTTPTRAALSHSGSPGVVPEGNGTFLDDTHNVSEWREVLTGEEIPFEFEARGKLRHRHTHDLRIHQLQVRVNGWEQVSPVSVDKVGTFFRYAAPDKNSSSSTIGSPSSRTNIIHPQVYFSSLPPVRVVFAVTMEGSARKVITVRSALIVRNRLETPMELRLDSPSAPDKPVVLPAIMPGDSFAVPLHLTSWRLQARPKGLGVFFCKAPIHWTNVVKTAEISSSKRECHSMDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 17162 - protein, 192 aa, Homo sapiens
MLLEETGLTPQETCLSPRRPHRWQRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 17163 - protein, 386 aa, Homo sapiens
MRGEKLSKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 17164 - protein, 125 aa, Homo sapiens
EFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 17165 - protein, 125 aa, Homo sapiens; identical to SEQ ID NO: 17164

SEQ ID NO: 17166 - protein, 598 aa, Homo sapiens
MEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 17167 - protein, 598 aa, Homo sapiens; identical to SEQ ID NO: 17166

SEQ ID NO: 17168 - protein, 701 aa, Homo sapiens
MEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 17169 - protein, 701 aa, Homo sapiens; identical to SEQ ID NO: 17168

SEQ ID NO: 17170 - protein, 598 aa, Homo sapiens; identical to SEQ ID NO: 17166

SEQ ID NO: 17171 - protein, 701 aa, Homo sapiens; identical to SEQ ID NO: 17168

SEQ ID NO: 17172 - protein, 670 aa, Homo sapiens
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 17173 - protein, 547 aa, Homo sapiens
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDRHLQQYSAAGSGSGCCL

SEQ ID NO: 17174 - protein, 422 aa, Homo sapiens
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 17175 - protein, 832 aa, Homo sapiens
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQLLLDTHSLKMVLLDLPSISSQVVRKAPASYTKIVVKGMTRAEMILKVVMAPHEPLVVFVDNYIKLLTDCNTETFQKILDMKGLKRSEQSSMLELLRQRLPAPPSGAESSGSLSLTAPTPEQESSRIRKLEKLIKKRL

SEQ ID NO: 17176 - protein, 501 aa, Homo sapiens
MFSLIVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 17177 - protein, 128 aa, Homo sapiens
MVLLDLPSISSQVVRKAPASYTKIVVKGMTRAEMILKVVMAPHEPLVVFVDNYIKLLTDCNTETFQKILDMKGLKRSEQSSMLELLRQRLPAPPSGAESSGSLSLTAPTPEQESSRIRKLEKLIKKRL

SEQ ID NO: 17178 - protein, 977 aa, Homo sapiens
MASSHSSSPVPQGSSSDVFFKIEVDPSKHIRPVPSLPDVCPKEPTGDSHSLYVAPSLVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 17179 - protein, 966 aa, Homo sapiens
MASSHSSSPVPQGSSSDVFFKIEVDPSKHIRPVPSLPDVCPKEPTGDSHSLYVAPSLVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKIWM

SEQ ID NO: 17180 - protein, 965 aa, Homo sapiens
MASSHSSSPVPQGSSSDVFFKIEVDPSKHIRPVPSLPDVCPKEPTVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 17181 - protein, 965 aa, Homo sapiens; identical to SEQ ID NO: 17180

SEQ ID NO: 17182 - protein, 1428 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFGKYQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 17183 - protein, 202 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFDQNQALRLCLGSTSVGGQYGAISA

SEQ ID NO: 17184 - protein, 1426 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 17185 - protein, 1428 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFGKDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 17186 - protein, 140 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKG

SEQ ID NO: 17187 - protein, 121 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKK

SEQ ID NO: 17188 - protein, 1336 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 17189 - protein, 74 aa, Homo sapiens
MENEPDHENVEQSLCAKTSEEELNKSFNLEASLSKFSYIDMDKELEFKNDLIDDKEFDIPQVDTPPTLESILNE

SEQ ID NO: 17190 - protein, 246 aa, Homo sapiens
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESEVEEPLSQESQVEEPLSQESEVEEPLSQESQVEEPLSQESEMEEPLSQESQVEEPLSQESEMEEPLSQESEMEELPSV

SEQ ID NO: 17191 - protein, 125 aa, Homo sapiens
MSPKPRASGPPAKAKETGKRKSSSQPSPSGPKKKTTKVAEKGEAVRGGRRGKKGAATKMAAVTAPEAESGPAAPGPSDQPSQELPQHELPPEEPVSEGTQHDPLSQESELEEPLSKGRPSTPLSP

SEQ ID NO: 17192 - protein, 702 aa, Homo sapiens
MTSRNQLVQKVLQELQEAVECEGLEGLIGASLEAKQVLSSFTLPTCREGGPGLQVLEVDSVALSLYPEDAPRNMLPLVCKGEGSLLFEAASMLLWGDAGLSLELRARTVVEMLLHRHYYLQGMIDSKVMLQAVRYSLCSEESPEMTSLPPATLEAIFDADVKASCFPSSFSNVWHLYALASVLQRNIYSIYPMRNLKIRPYFNRVIRPRRCDHVPSTLHIMWAGQPLTSHFFRHQYFAPVVGLEEVEAEGAPGVAPALPALAPLSSPAKTLELLNREPGLSYSHLCERYSVTKSTFYRWRRQSQEHRQKVAARFSAKHFLQDSFHRGGVVPLQQFLQRFPEISRSTYYAWKHELLGSGTCPALPPREVLGMEELEKLPEEQVAEEELECSALAVSSPGMVLMQRAKLYLEHCISLNTLVPYRCFKRRFPGISRSTYYNWRRKALRRNPSFKPAPALSAAGTPQLASVGEGAVIPWKSEAEEGAGNATGEDPPAPGELLPLRMPLSRWQRRLRRAARRQVLSGHLPFCRFRLRYPSLSPSAFWVWKSLARGWPRGLSKLQVPVPTLGKGGQEAEEKQEKEAGRDVTAVMAPPVGASSEDVEGGPSREGALQEGATAQGQPHSGPLLSQPVVAAAGGRDGRMLVMDMIATTKFKAQAKLFLQKRFQSKSFPSYKEFSALFPLTARSTYYMWKRALYDGLTLVDG

SEQ ID NO: 17193 - protein, 83 aa, Homo sapiens
MTSRNQLVQKVLQELQEAVECEGLEGLIGASLEAKQVLSSFTLPTCREGGPGLQVLEVDSVALSLYPEDAPRNMLPLVCKGEG

SEQ ID NO: 17194 - protein, 419 aa, Homo sapiens
MAKEGVEKAEETEQMIEKEAGKEPAEGGGGDGSHRLGDAQEMRAVVLAGFGGLNKLRLFRKAMPEPQDGELKIRVKACGLNFIDLMVRQGNIDNPPKTPLVPGFECSGIVEALGDSVKGYEIGDRVMAFVNYNAWAEVVCTPVEFVYKIPDDMSFSEAAAFPMNFVTAYVMLFEVANLREGMSVLVHSAGGGVGQAVAQLCSTVPNVTVFGTASTFKHEAIKDSVTHLFDRNADYVQEVKRISAEGVDIVLDCLCGDNTGKGLSLLKPLGTYILYGSSNMVTGETKSFFSFAKSWWQVEKVNPIKLYEENKVIAGFSLLNLLFKQGRAGLIRGVVEKLIGLYNQKKIKPVVDSLWALEEVKEAMQRIHDRGNIGKLILDVEKTPTPLMANDSTETSEAGEEEEDHEGDSENKERMPFIQ

SEQ ID NO: 17195 - protein, 215 aa, Homo sapiens
MVLLTMIARVADGLPLAASMQEDEQSGRDLQQYQSQAKQLFRKLNEQSPTRCTLEAGAMTFHYIIEQGVCYLVLCEAAFPKKLAFAYLEDLHSEFDEQHGKKVPTVSRPYSFIEFDTFIQKTKKLYIDSRARRNLGSINTELQDVQRIMVANIEEVLQRGEALSALDSKANNLSSLSKKYRQDAKYLNMRSTYAKLAAVAVFFIMLIVYVRFWWL

SEQ ID NO: 17196 - protein, 290 aa, Homo sapiens
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 17197 - protein, 295 aa, Homo sapiens
MTENTHFDKIPESCALKSWRHPGLHHGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 17198 - protein, 169 aa, Homo sapiens
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQVGLCLGGWRG

SEQ ID NO: 17199 - protein, 200 aa, Homo sapiens
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPS

SEQ ID NO: 17200 - protein, 127 aa, Homo sapiens
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSL

SEQ ID NO: 17201 - protein, 296 aa, Homo sapiens
MLFMKMDLLNYQYLDKMNNNIGILCYEGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 17202 - protein, 224 aa, Homo sapiens
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEP

SEQ ID NO: 17203 - protein, 206 aa, Homo sapiens
MNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 17204 - protein, 210 aa, Homo sapiens
MIKVRNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 17205 - protein, 301 aa, Homo sapiens
MASRYVAVGMILSQTVVGVLGSFSVLLHYLSFYCTGCRLRSTDLIVKHLIVANFLALRCKGVPQTMAAFGVRYFLNALGCKLVFYLHRVGRGVSIGTTCLLSVFQVITVSSRKSRWAKLKEKAPKHVGFSVLLCWIVCMLVNIIFPMYVTGKWNYTNITVNEDLGYCSGGGNNKIAQTLRAMLLSFPDVLCLGLMLWVSSSMVCILHRHKQRVQHIDRSNLSPRASPENRATQSILILVSTFVSSYTLSCLFQVCMALLDNPNSLLVNTSALMSVCFPTLSPFVLMSCDPSVYRFCFAWKR

SEQ ID NO: 17206 - protein, 725 aa, Homo sapiens
MPPFLLLEAVCVFLFSRVPPSLPLQEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYSWKRVFLTHPATCYRTTCPGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGGEWGNPHPQGCPHGRPSA

SEQ ID NO: 17207 - protein, 416 aa, Homo sapiens
MATKGMRLKSTKEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGVVKKCVSRTQALVGFSYGDTKVVSTSFITPVGGAMPCPLLQVGDYVFAKIVIPKGFDFYVPAIVIALPNKHVATEKFYTVLKCNNRREFCPRSALIKISQNKYALSCSHIKSPPIPEDPEVEDVEARNSAFLFWPLKEADTQDSREPRREKPRRKKRPAKQPLQQAAPSDSDGSSHGISSHGSCQGTHPEPRTAHLHFPAAGRLGLSSHAIIATPPPRAALPCTLQATHSSKGLRSVPETL

SEQ ID NO: 17208 - protein, 624 aa, Homo sapiens
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLTAKSELIYQFVEHLTQAVESYKQRMDWLTSKSRQIFGVILEQCVTIVLDFGGILEGELDLCREALTMVLQEQVAHITEFNIIRVSQEPVKWQENATPVTEQSIATAISWVEKLTVELTVSEAGRLDALLEAGRDKTIESIYYFVVGDVPEESKELLLQRALEIPCPVYTVSFNARGEGTIAFLKDLSAKTHSRFHAFAERTECVEFPAFSTKDGDNVMTWNSRKLKGKLPPGAGVREDVFLVWQEMEEACSTLAQIQRLVAEPPKPDVATVDCESETTSVEIASNPEDTWDSKTWLQKYGLKAQKLSLYDVLADCSFRHADGVVDIKAKPENESVQTSAETNKKTVHAKYCSRFVHAPWKDGSLVHVNITKEKCKWYSERIHTALARIRRRIKWLQDGSQSLFGRLHNDCIYILIDTSHSMKSKLDLVKDKIIQFIQEQLKYKSKFNFVKFDGQAVAWREQLAEVNEDNLEQAQSWIRDIKIGSSTNTLSALKTAFADKETQAIYLLTDGRPDQGTSSHLLLTAAV

SEQ ID NO: 17209 - protein, 475 aa, Homo sapiens
MWRLWGDLWLLGMLMVCFHSSTEQKMAEYTMVSQEPVKWQENATPVTEQSIATAISWVEKLTVELTVSEAGRLDALLEAGRDKTIESIYYFVVGDVPEESKELLLQRALEIPCPVYTVSFNARGEGTIAFLKDLSAKTHSRFHAFAERTECVEFPAFSTKDGDNVMTWNSRKLKGKLPPGAGVREDVFLVWQEMEEACSTLAQIQRLVAEPPKPDVATVDCESETTSVEIASNPEDTWDSKTWLQKYGLKAQKLSLYDVLADCSFRHADGVVDIKAKPENESVQTSAETNKKTVHAKYCSRFVHAPWKDGSLVHVNITKEKCKWYSERIHTALARIRRRIKWLQDGSQSLFGRLHNDCIYILIDTSHSMKSKLDLVKDKIIQFIQEQLKYKSKFNFVKFDGQAVAWREQLAEVNEDNLEQAQSWIRDIKIGSSTNTLSALKTAFADKETQAIYLLTDGRPDQQPFKEGVSVLSHR

SEQ ID NO: 17210 - protein, 1294 aa, Homo sapiens
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLTAKSELIYQFVEHLTQAVESYKQRMDWLTSKSRQIFGVILEQCVTIVLDFGGILEGELDLCREALTMVLQEQVAHITEFNIIRVSQEPVKWQENATPVTEQSIATAISWVEKLTVELTVSEAGRLDALLEAGRDKTIESIYYFVVGDVPEESKELLLQRALEIPCPVYTVSFNARGEGTIAFLKDLSAKTHSRFHAFAERTECVEFPAFSTKDGDNVMTWNSRKLKGKLPPGAGVREDVFLVWQEMEEACSTLAQIQRLVAEPPKPDVATVDCESETTSVEIASNPEDTWDSKTWLQKYGLKAQKLSLYDVLADCSFRHADGVVDIKAKPENESVQTSAETNKKTVHAKYCSRFVHAPWKDGSLVHVNITKEKCKWYSERIHTALARIRRRIKWLQDGSQSLFGRLHNDCIYILIDTSHSMKSKLDLVKDKIIQFIQEQLKYKSKFNFVKFDGQAVAWREQLAEVNEDNLEQAQSWIRDIKIGSSTNTLSALKTAFADKETQAIYLLTDGRPDQPPETVIDQVKRFQEIPIYTISFNYNDEIANRFLKEVAALTGGEFHFYNFGCKDPTPPEAVQNEDLTLLVKEMEQGHSDLEKMQDLYSESLIMDWWYNAEKDGDSKHQKEICSMISTPEKCAKPQSDVDSTQTSSLNMLKGPWGLSDQKVQKKKVLHAESTKTSLLRSQMSSLRSSACSERKDGLSNASSRRTALSDKEMSILLAEEWLDDKSSEKVTREGSQVYDHDSSDVSSENWLKTYGLVAKKLTLMDALSVAAVPHSSTYVPVLDKHVVSKVFDEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGVVKKCVSRTQALVGFSYGDTKVVSTSFITPVGGAMPCPLLQVGDYVFAKIVIPKGFDFYVPAIVIALPNKHVATEKFYTVLKCNNRREFCPRSALIKISQNKYALSCSHIKSPPIPEDPEVEDVEARNSAFLFWPLKEADTQDSREPRREKPRRKKRPAKQPLQQAAPSDSDGSSHGISSHGSCQGTHPEPRTAHLHFPAAGRLGLSSHAIIATPPPRAALPCTLQATHSSKGLRSVPETL

SEQ ID NO: 17211 - protein, 1242 aa, Homo sapiens
MPGLYCPSSWTPLPLTDSWVRACANGPCLSVRARLTYRNPQPQPVDGVFVYPLAEAEVVSGFEAEAAGRRVSFQLQSRRRSQAACCRALGPGLGTPTPRRCAQGHLVLDLAQARSTLVLPTGIIAAAGTMTVTLHSSRELPSRPDGVLHVALPTVLTPLAPPGPPGPPRPPGLCDDSPTSCFGVGSLQEEGLAWEELAAPRDVFSGPARCPAPYTFSFEMLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQSTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 17212 - protein, 891 aa, Homo sapiens
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQDRHTTPTGSSDPILTTATPAFSPFTLVAQGRAGAGLAAGSPWWGTVGGVLLLLGLASW

SEQ ID NO: 17213 - protein, 688 aa, Homo sapiens
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVESQSWGSSAAFLPRHPSRGPRGCRTRPGALGARGTSGARSPRSLAVAHAAVNP

SEQ ID NO: 17214 - protein, 852 aa, Homo sapiens
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQVRNHYFPSQGPAHHPYRLI

SEQ ID NO: 17215 - protein, 944 aa, Homo sapiens
MSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKRHL

SEQ ID NO: 17216 - protein, 170 aa, Homo sapiens
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEGFFAKIVKSPHT

SEQ ID NO: 17217 - protein, 1507 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 17218 - protein, 1507 aa, Homo sapiens; identical to SEQ ID NO: 17217

SEQ ID NO: 17219 - protein, 327 aa, Homo sapiens
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 17220 - protein, 284 aa, Homo sapiens
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLR

SEQ ID NO: 17221 - protein, 120 aa, Homo sapiens [sequence omitted]

SEQ ID NO: 17222 - protein, 187 aa, Homo sapiens
MGAPLAVALGALHYLALFLQLGGATRPAGHAPWDNHVSGHALFTETPHDMTARTGEDVEMACSFRGSGSPSYSLEIQWWYVRSHRDWTDKQAWASNQVVKVVGSNISHKLRLSRVKPTDEGTYECRVIDFSDGKARHHKVKAYLRVQPGENSVLHLPEAPPAAPAPPPPKPGKELRKRSVDQEACSL

SEQ ID NO: 17223 - protein, 204 aa, Homo sapiens
MGAPLAVALGALHYLALFLQLGGATRPAGHAPWDNHVSGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGENSVLHLPEAPPAAPAPPPPKPGKELRKRSVDQEACSL

SEQ ID NO: 17224 - protein, 149 aa, Homo sapiens
MGAPLAVALGALHYLALFLQLGGATRPAGHAPWDNHVSGHALFTETPHDMTARTGEDVEMACSFRGSGSPSYSLEIQWWYVRSHRDWTDKQAWASNQVVKVVGSNISHKLRLSRVKPTDEGTYECRVIDFSDGKARHHKVKAYLRVQPG

SEQ ID NO: 17225 - protein, 285 aa, Homo sapiens
MEQRNRLGALGYLPPLLLHALLLFVADAAFTEVPKDVTVREGDDIEMPCAFRASGATSYSLEIQWWYLKEPPRELLHELALSVPGARSKVTNKDATKISTVRVQGNDISHRLRLSAVRLQDEGVYECRVSDYSDDDTQEHKAQAMLRVLSRFAPPNMQAAEAVSHIQSSGPRRHGPASAANANNAGAASRTTSEPGRGDKSPPPGSPPAAIDPAVPEAAAASAAHTPTTTVAAAAAASSASPPSGQAVLLRQRHGSGTGRSYTTDPLLSLLLLALHKFLRLLLGH

SEQ ID NO: 17226 - protein, 677 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGEVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGSNAQYIVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 17227 - protein, 676 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGSNAQYIVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 17228 - protein, 400 aa, Homo sapiens
MAAEIQPKPLTRKPILLQRMEGSQEVVNMAVIVPKEEGVISVSEDRTVRVWLKRDSGQYWPSVYHAMPSPCSCMSFNPETRRLSIGLDNGTISEFILSEDYNKMTPVKNYQAHQSRVTMILFVLELEWVLSTGQDKQFAWHCSESGQRLGGYRTSAVASGLQFDVETRHVFIGDHSGQVTILKLEQENCTLVTTFRGHTGGVTALCWDPVQRVLFSGSSDHSVIMWDIGGRKGTAIELQGHNDRVQALSYAQHTRQLISCGGDGGIVVWNMDVERQETPEWLDSDSCQKCDQPFFWNFKQMWDSKKIGLRQHHCRKCGKAVCGKCSSKRSSIPLMGFEFEVRVCDSCHEAITDEERAPTATFHDSKHNIVHVHFDATRGWLLTSGTDKVIKLWDMTPVVS

SEQ ID NO: 17229 - protein, 421 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 17230 - protein, 275 aa, Homo sapiens
MASFPPRVNEKEIGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 17231 - protein, 213 aa, Homo sapiens
MASFPPRVNEKEIDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 17232 - protein, 404 aa, Homo sapiens
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 17233 - protein, 179 aa, Homo sapiens
MRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 17234 - protein, 194 aa, Homo sapiens
MLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 17235 - protein, 485 aa, Homo sapiens
MAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDHGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 17236 - protein, 432 aa, Homo sapiens
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHALPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 17237 - protein, 581 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEERLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVGSLSSPSQASSPGGTVV

SEQ ID NO: 17238 - protein, 569 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEERLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 17239 - protein, 511 aa, Homo sapiens
MNEIKTQFTTREGLYKLLPHSEYSRPNRVPFNSQGSNPVRVSFVNLNDQSGNGDRLCFNVGRELYFYIYKGVRKRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVGSLSSPSQASSPGGTVV

SEQ ID NO: 17240 - protein, 445 aa, Homo sapiens
MWAGSCTSISTRGSARQSHERLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 17241 - protein, 600 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEENSCQHLWKVDWNEERQNEGSKTSEEALVTVQRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 17242 - protein, 312 aa, Homo sapiens
MKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 17243 - protein, 396 aa, Homo sapiens
MYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 17244 - protein, 508 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 17245 - protein, 195 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEENSCQHLWKVDWNEERQNEGSKTSEEALVTVQPAEHFCRQEDRMQGVLQDQN

SEQ ID NO: 17246 - protein, 520 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVGSLSSPSQASSPGGTVV

SEQ ID NO: 17247 - protein, 920 aa, Homo sapiens
MGKKRTTSGEGRERQRLPARRFRTTSPAALRADSVDGGSLLAPLLGLTDRAFSDCPDLADGAMEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGEATEAGPREWAMAGCVPILPVLSCRILRLHHSFAHGPMQDAESTANDARESWGCPLYPLGLCSGPQAGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRCHRCASMCAVCHHVVKGLFVWCQGCSHGGHLQHIMKWLEGSSHCPAGCGHLCEYS

SEQ ID NO: 17248 - protein, 790 aa, Homo sapiens
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRCHRCASMCAVCHHVVKGLFVWCQGCSHGGHLQHIMKWLEGSSHCPAGCGHLCEYS

SEQ ID NO: 17249 - protein, 544 aa, Homo sapiens
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 17250 - protein, 544 aa, Homo sapiens; identical to SEQ ID NO: 17249

SEQ ID NO: 17251 - protein, 287 aa, Homo sapiens
MPALCLVLCWFQGLLGEVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 17252 - protein, 544 aa, Homo sapiens; identical to SEQ ID NO: 17249

SEQ ID NO: 17253 - protein, 857 aa, Homo sapiens
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQGLVPRGTVMGSLLGKVLCLQLSLDDHVVAVCAGNKIFMLDIEQRFSVTYIERPDVNNRHKVPPPTFLHTFSQTQAVRAELQGHLGPVTAVEFCPWRAGTLISASEDRGFKVWDHCTGSLIYSSSVLSAYPLLSLFIDAESRQLVTGCADGQLWIFSLMDGHHYRRVARVDLRKKTETFSTRRVKSGLCSQPEESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGDGQWLACGLANHLLLVFDASLTGTPAVFSGHDGAVNAVCWSQDRRWLLSAARDGTLRMWSARGAELALLLGKDMFSKPIQSAQFYYIDAFILLSSGPEFQLLRYHIDTCKDEIKRYKQKSKSKLICRLSTTGAVDMTSLSAVNDFYSHIVLAAGRNRTVEVFDLNAGCSAAVIAEAHSRPVHQICQNKGSSFTTQQPQAYNLFLTTAIGDGMRLWDLRTLRCERHFEGHPTRGYPCGIAFSPCGRFAACGAEDRHAYVYEMGSSTFSHRLAGHTDTVTGVAFNPSAPQLATATLDGKLQLFLAE

SEQ ID NO: 17254 - protein, 181 aa, Homo sapiens
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQGLVPRGTVMGSLLGKVLCLQLSLDDHVVAVCAGNKIFMLDIEHILFSVYSLMQKAGSWSPGVLTASFGSSV

SEQ ID NO: 17255 - protein, 730 aa, Homo sapiens
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQAYPLLSLFIDAESRQLVTGCADGQLWIFSLMDGHHYRRVARVDLRKKTETFSTRRVKSGLCSQPEESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGDGQWLACGLANHLLLVFDASLTGTPAVFSGHDGAVNAVCWSQDRRWLLSAARDGTLRMWSARGAELALLLGKDMFSKPIQSAQFYYIDAFILLSSGPEFQLLRYHIDTCKDEIKRYKQKSKSKLICRLSTTGAVDMTSLSAVNDFYSHIVLAAGRNRTVEVFDLNAGCSAAVIAEAHSRPVHQICQNKGSSFTTQQPQAYNLFLTTAIGDGMRLWDLRTLRCERHFEGHPTRGYPCGIAFSPCGRFAACGAEDRHAYVYEMGSSTFSHRLAGHTDTVTGVAFNPSAPQLATATLDGKLQLFLAE

SEQ ID NO: 17256 - protein, 895 aa, Homo sapiens
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQGLVPRGTVMGSLLGKVLCLQLSLDDHVVAVCAGNKIFMLDIEQRFSVTYIERPDVNNRHKVPPPTFLHTFSQTQAVRAELQGHLGPVTAVEFCPWRAGTLISASEDRGFKVWDHCTGSLIYSSSVLSAYPLLSLFIDAESRQLVTGCADGQLWIFSLMDGHHYRRVARVDLRKKTETFSTRRVKSGLCSQPEESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGDGQWLACGLANHLLLVFDASLTGTPAVFSGHDGAVNAVCWSQDRRWLLSAARDGTLRMWSARGAELALLLGKDMFSKPIQSAQFYYIDAFILLSSGPEFQLLRYHIDTCKDEIKRYKQKSKSKLICRLSTTGAVDMTSLSAVNDFYSHIVLAAGRNRTVEVFDLNAGCSAAVIAEAHSRPVHQICQNKGSSFTTQQPQAYNLFLTTAIGDGMRLWDLRTLRCERHFEGHPTRGYPCGIAFSPCGRFAACGAEDRHAYVYEMGSSTFSHRLAGHTDTVTGVAFNPSAPQMESRSVAHAGVQWHDLGSLQPPPSRFKQFFCLSLPSSWDYSLPQLPWMVNSSSF

SEQ ID NO: 17257 - protein, 88 aa, Homo sapiens
MENPQDIFSSNGGCLSDIVIEKYLVESKESVSHVQLACSMQDCAFPLDGTELCIWNTKDPSHQLLILRGHHQPITAMAFGNKVNPLLI

SEQ ID NO: 17258 - protein, 366 aa, Homo sapiens
MLLLRCQLKQAPPQKVSFRFCVVMGKQQSKLKHSTYKYGPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 17259 - protein, 367 aa, Homo sapiens
MLLLRCQLKQAPPQKVSFRFCVVMGKQQSKLKHSTYKYGRPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 17260 - protein, 242 aa, Homo sapiens
MVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 17261 - protein, 1336 aa, Homo sapiens
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQIQPPPSSGTPLLGPQPFPGQGPMSQIPQGFQQPHPSQQMPMNMAQMGPPGPQGQFRPPGPQGQMGPQGPPLHQGGGGPQGFMGPQGPQGPPQGLPRPQDMHGPQGMQRHPGPHGPLGPQGPPGPQGSSGPQGHMGPQGPPGPQGHIGPQGPPGPQGHLGPQGPPGTQGMQGPPGPRGMQGPPHPHGIQGGPGSQGIQGPVSQGPLMGLNPRGMQGPPGPRENQGPAPQGMIMGHPPQEMRGPHPPGGLLGHGPQEMRGPQEIRGMQGPPPQGSMLGPPQELRGPPGSQSQQGPPQGSLGPPPQGGMQGPPGPQGQQNPARGPHPSQGPIPFQQQKTPLLGDGPRAPFNQEGQSTGPPPLIPGLGQQGAQGRIPPLNPGQGPGPNKGDSRGPPNHHMGPMSERRHEQSGGPEHGPERGPFRGGQDCRGPPDRRGPHPDFPDDFSRPDDFHPDKRFGHRLREFEGRGGPLPQEEKWRRGGPGPPFPPDHREFSEGDGRGAARGPPGAWEGRRPGDERFPRDPEDPRFRGRREESFRRGAPPRHEGRAPPRGRDGFPGPEDFGPEENFDASEEAARGRDLRGRGRGTPRGGRKGLLPTPDEFPRFEGGRKPDSWDGNREPGPGHEHFRDTPRPDHPPHDGHSPASRERSSSLQGMDMASLPPRKRPWHDGPGTSEHREMEAPGGPSEDRGGKGRGGPGPAQRVPKSGRSSSLDGEHHDGYHRDEPFGGPPGSGTPSRGGRSGSNWGRGSNMNSGPPRRGASRGGGRGR

SEQ ID NO: 17262 - protein, 257 aa, Homo sapiens
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRDTCFHHCRCYFLSVKR

SEQ ID NO: 17263 - protein, 118 aa, Homo sapiens
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKV

SEQ ID NO: 17264 - protein, 326 aa, Homo sapiens
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREARFIHNIPFSVVPIVMVKLFSKCILGAEMHGLCQFLGNFLHPINTIFFFVFTHSPFCWHLSEVVLSRYQPLQYVRDVLSAAFCTGFLFSFMINNVYTLFLFIIYCVRQEYFIPNKEFSL

SEQ ID NO: 17265 - protein, 494 aa, Homo sapiens
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSISGEDEVECSDKDEPDLDGDVSSDCPTIRVPLTSLKSHQGVVIASDWLVGGKQAVTASWDRTANLYDVETSELVHSLTGHDQELTHCCTHPTQRLVVTSSRDTTFRLWDFRDPSIHSVNVFQGHTDTVTSAVFTVGDNVVSGSDDRTVKVWDLKNMRSPIATIRTDSAINRINVCVGQKIIALPHDNRQVRLFDMSGVRLARLPRSSRQGHRRMVCCSAWSEDHPVCNLFTCGFDRQAIGWNINIPALLQEK

SEQ ID NO: 17266 - protein, 494 aa, Homo sapiens; identical to SEQ ID NO: 17265

SEQ ID NO: 17267 - protein, 249 aa, Homo sapiens
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSVSTFPYL

SEQ ID NO: 17268 - protein, 209 aa, Homo sapiens
MSSDSEWDRSACSDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTS

SEQ ID NO: 17269 - protein, 314 aa, Homo sapiens
MNSGVPATLAVRRVKFFGQHGGEVNSSAFSPDGQMLLTGSEDGCVYGWETRSGQLLWRLGGHTGPVKFCRFSPDGHLFASASCDCTVRLWDVARAKCLRVLKGHQRSVETVSFSPDSRQLASGGWDKRVMLWDVQSGQMLRLLVGHRDSIQSSDFSPTVNCLATGSWDSTVHIWDLRMVTPAVSHQALEGHSANISCLCYSASGLLASGSWDKTIHIWKPTTSSLLIQLKGHVTWVKSIAFSPDELWLASAGYSRMVKVWDCNTGKCLETLKGVLDVAHTCAFTPDGKILVSGAADQTRRQISRTSKSPRDPQT

SEQ ID NO: 17270 - protein, 459 aa, Homo sapiens
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPKNCVVAAVGKELIIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHVARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 17271 - protein, 205 aa, Homo sapiens
MQAYERNFWDPSPQLDTQQEIKLCQKSNDISIHHFTCDEENVFAAVGRGLYVYSLQMKRVIACQKTAHDSNVLHVARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 17272 - protein, 361 aa, Homo sapiens
MTQQPLRGVTSLRFNQDQSCFCCAMETGVRIYNVEPLMEKGHLDHEQVGSMGLVEMLHRSNLLALVGGGSSPKFSEISAVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 17273 - protein, 610 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 17274 - protein, 610 aa, Homo sapiens [sequence omitted]

SEQ ID NO: 17275 - protein, 322 aa, Homo sapiens
KSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTASLWSPAMKEPLAKILCHRGGVRAVAVDSTGTYMATSGLDHQLKIFDLRGTYQPL

SEQ ID NO: 17276 - protein, 610 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 17277 - protein, 610 aa, Homo sapiens; identical to SEQ ID NO: 17276

SEQ ID NO: 17278 - protein, 322 aa, Homo sapiens
KSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPL

SEQ ID NO: 17279 - protein, 322 aa, Homo sapiens
KSRISKKPQVPKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPL

SEQ ID NO: 17280 - protein, 322 aa, Homo sapiens; identical to SEQ ID NO: 17278

SEQ ID NO: 17281 - protein, 322 aa, Homo sapiens; identical to SEQ ID NO: 17278

SEQ ID NO: 17282 - protein, 610 aa, Homo sapiens; identical to SEQ ID NO: 17276

SEQ ID NO: 17283 - protein, 891 aa, Homo sapiens
MTAEETVNVKEVEIIKLILDFLNSKKLHISMLALEKESGVINGLFSDDMLFLRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 17284 - protein, 891 aa, Homo sapiens; identical to SEQ ID NO: 17283

SEQ ID NO: 17285 - protein, 919 aa, Homo sapiens
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 17286 - protein, 920 aa, Homo sapiens
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERSDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 17287 - protein, 927 aa, Homo sapiens
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHVRFLFLKLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERSDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 17288 - protein, 106 aa, Homo sapiens
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDE

SEQ ID NO: 17289 - protein, 173 aa, Homo sapiens
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVA

SEQ ID NO: 17290 - protein, 697 aa, Homo sapiens
MAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQVISSDTGSTVSFWMIDTGQKIKQFTGCHGNAEISTMALDANETRLLTGSTDGTVKIWDFNGYCHHTLNVGQDGAVDISQILILKKKILVTGWERAITVFRPQNFNQFFIQPEEWKGGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFLKARKNTAVTGGANLVSCGGSGYVRFWDIYKKQLLAEFLAHSGVGSIIMSTDKMNRYLTTGDLDGWLKIWNIEEYCLNSSKNKITKAPTLIRSFQPHEDRISSLEMCEPGGQLLIISSSADCSICVTGVCNAPVWIFGQAKHWHIENCLFLPKRDTNLVESEIQKEISLFSKEESCLDPTEHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 17291 - protein, 662 aa, Homo sapiens
MTINWAELLSGCHKCCHILEHKLHQGDWVRQVTYNASLDAIISSTTSNTNSVVMAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQVISSDTGSTVSFWMIDTGQKIKQFTGCHGNAEISTMALDANETRLLTGSTDGTVKIWDFNGYCHHTLNVGQDGAVDISQILILKKKILVTGWERYDYASWKTIGRAITVFRPQNFNQFFIQPEEWKGGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFLKARKNTAVTGGANLVSCGGSGYVRFWDIYKKQLLAEFLAHSGVGSIIMSTDKMNRYLTTGDLDGWLKIWNIEEESCLDPTEHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 17292 - protein, 982 aa, Homo sapiens
MKEPDDQDTDGEKSVTSKSDGKKSLRSSKSESRSPVQEDNTFLEDDTDETFTKGEGSYLEEDSDEERLEGSLSSFQYGDLQSTTVPQQTPAPAVEEAEEEVKKKISESFFYDYMELASMPFVTLDSNIPLDLLTLVHSFGYDCRKRANLQLLDDSIAIYIAGNQLIFLNLKTKEQIYLRSSSGEGIGVIGVHPHKTYFTVAEKGSFPDIIIYEYPSLRPYRVLRDGTEKGYAYVDFNYSGNLLASVGSNPDYTLTIWNWKEEQPILRTKAFSQEVFKVTFNPDKEEQLTTSGSGHIKFWEMAFTFTGLKLQGSLGRFGKTITTDIEGYMELPDGKVLSGSEWGNMLLWEGGLIKVELCRGTSKSCHNGPINQIMLYEGEVITVGSDGYVRIWDFETIDTADVIDETGLLEIEPINELQVDKNVNLFSMIKMNETGNNFWLAQDANGAIWKLDLSFSNITQDPECLFSFHSGAIEAVAVSPLTYLMATTALDCSVRIYDFASKTPLAQMKFKQGGTALVWVPRMVNFTGAQIIVGFEDGVVRILELYDPKGLTIFAGRKKILDADIQLKQVFKPHTACVTALAYERDGEILATGSKDQTVFFFEVERDYKPIGYINTPGPVCQLMWSPMSHPESTLLIICENGYILEAPLPTIKQEEDDHDVVSYEIKDMCIKCFHFSSVKSKILRLIEIEKRERQRELKEKIREERRNKLAAEMGEDGEKEFQEEEEEKEEEEEEEEPLPEIFIPSTPSPILCGFYSEPGKFWVSLGGYDSGFLYHCEFPPCDESSDFKEQKDEPIDVRYLADTEDNPIQTITFNINKVMMFCGMKNGAIRVYVLNQNDPSLTSLVDYWHFNMHDNNYGCIKSIANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTVSLI

SEQ ID NO: 17293 - protein, 401 aa, Homo sapiens
MKLSDLHHVTLFQEILLLKNFEKQENILQERVNSLDKEEQYMQWKINETLKEMEEKKNEITKLQEQEKALYAGFQAAIGENNKFANFLMKVLKKKIKRVKKKEVEGDADEDEESEESSEEESSLESDEDESESEDEVFDDSICPTNCDVALFELALHLREKRLDIEEALVEEKKIVDNLKKEYDTLSKKVKIVATNLNAAEEALEAYQREKQQRLNELLVVIPLKLHQIEYVVFGEIPSDLSGTLVFSNHALRRLQERIHELQEENSKQQKLNKEWRERRKQLIREKREMTKTIHKMEETVRQLMISKFGRVVNLEALQTLSVNTTLEELKIRKLRKELANAKEMKMWEEKIAQMRWELMMKTKEHTRKLYQMNDLCIEKKKLDSRLNTLQNQQNPGNGLS

SEQ ID NO: 17294 - protein, 1854 aa, Homo sapiens
MKEPDDQDTDGEKSVTSKSDGKKSLRSSKSESRSPVQEDNTFLEDDTDETFTKGEGSYLEEDSDEERLEGSLSSFQYGDLQSTTVPQQTPAPAVEEAEEEVKKKISESFFYDYMELASMPFVTLDSNIPLDLLTLVHSFGYDCRKRANLQLLDDSIAIYIAGNQLIFLNLKTKEQIYLRSSSGEGIGVIGVHPHKTYFTVAEKGSFPDIIIYEYPSLRPYRVLRDGTEKGYAYVDFNYSGNLLASVGSNPDYTLTIWNWKEEQPILRTKAFSQEVFKVTFNPDKEEQLTTSGSGHIKFWEMAFTFTGLKLQGSLGRFGKTITTDIEGYMELPDGKVLSGSEWGNMLLWEGGLIKVELCRGTSKSCHNGPINQIMLYEGEVITVGSDGYVRIWDFETIDTADVIDETGLLEIEPINELQVDKNVNLFSMIKMNETGNNFWLAQDANGAIWKLDLSFSNITQDPECLFSFHSGAIEAVAVSPLTYLMATTALDCSVRIYDFASKTPLAQMKFKQGGTALVWVPRMVNFTGAQIIVGFEDGVVRILELYDPKGLTIFAGRKKILDADIQLKQVFKPHTACVTALAYERDGEILATGSKDQTVFFFEVERDYKPIGYINTPGPVCQLMWSPMSHPESTLLIICENGYILEAPLPTIKQEEDDHDVVSYEIKDMCIKCFHFSSVKSKILRLIEIEKRERQRELKEKIREERRNKLAAEMGEDGEKEFQEEEEEKEEEEEEEEPLPEIFIPSTPSPILCGFYSEPGKFWVSLGGYDSGFLYHCEFPPCDESSDFKEQKDEPIDVRYLADTEDNPIQTITFNINKVMMFCGMKNGAIRVYVLNQNDPSLTSLVDYWHFNMHDNNYGCIKSIANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTDFDVDSQIRAEMHRKTAFKIQQVEKELAWEKEKHELGLMKLKNRFRDPLESDTIVVHAILSDHKISSYRLVQPSKYSKFKRASQSERKPSKLDRFEKEGPGRKDSQRDAGGSVTIQEESIIEKGKKFRPKTLSEIIVENQIEKTRKLILKAERAQLKIQQRKKEWEELYKSKPGDDYEDPKDLQAIKEAQVYMGDFNLKTAPDYKIPEHMRINAAKKEEELGHLDSLVHGNKRHMNKCILSLRDLKVAVVEEIQCLVQELKNIQSTLHISKHIPIPKIPQIHPEEVPEKRFQYDEETLLNFKQQQMKSKDEKSPGVEQTGSGGPVGGFLKLSSRKDGDLTTRDSISRSSKASTFSLDIPKCLEFEKAEPTDVELEIMKRDEIKHVYMQQYLVNRIKELVVTFDAELRLLRHQKLKLDTQMKLSDLHHVTLFQEILLLKNFEKQENILQERVNSLDKEEQYMQWKINETLKEMEEKKNEITKLQEQEKALYAGFQAAIGENNKFANFLMKVLKKKIKRVKKKEVEGDADEDEESEESSEEESSLESDEDESESEDEVFDDSICPTNCDVALFELALHLREKRLDIEEALVEEKKIVDNLKKEYDTLSKKVKIVATNLNAAEEALEAYQREKQQRLNELLVVIPLKLHQIEYVVFGEIPSDLSGTLVFSNHALRRLQERIHELQEENSKQQKLNKEWRERRKQLIREKREMTKTIHKMEETVRQLMISKFGRVVNLEALQTLSVNTTLEELKIRKLRKELANAKEMKMWEEKIAQMRWELMMKTKEHTRKLYQMNDLCIEKKKLDSRLNTLQNQQGNAFQGPREADVVAREEVTELIQLQAERISALKEEIALLRRKGSLILPPIQSPREKEIQPADL

SEQ ID NO: 17295 - protein, 84 aa, Homo sapiens
MKEPDDQDTDGEKSVTSKSDGKKSLRSSKSESRSPVQEDNTFLEDDTDETFTKGEGSYLEEDSDEERLEGSLSSFQYGDLQSTT

SEQ ID NO: 17296 - protein, 358 aa, Homo sapiens
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 17297 - protein, 154 aa, Homo sapiens
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVS

SEQ ID NO: 17298 - protein, 160 aa, Homo sapiens
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQ

SEQ ID NO: 17299 - protein, 334 aa, Homo sapiens
MFRWERSIPLRGSAAALCNNLSVLQLPARNLTYFGVVHGPSAQLLSAAPEGVPLAQRQLHAKEGAGVSPPLITQVHWCVLPFRVLLVLTSHRGIQMYESNGYTMVYWHALDSGDASPVQAVFARGIAASGHFICVGTWSGRVLVFDIPAKGPNIVLSEELAGHQMPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEVEHCHGECVADTQLCGARFCDSSGNSFAVTGYDLAEIRRFSSV

SEQ ID NO: 17300 - protein, 974 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 17301 - protein, 458 aa, Homo sapiens
MSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKVGVWVPKFSLLFCIIV

SEQ ID NO: 17302 - protein, 330 aa, Homo sapiens
MATKESRDAKAQLALSSSANQSKEVPENPNYALKCTLVGHTEAVSSVKFSPNGEWLASSSADRLIIIWGAYDGKYEKTLYGHNLEISDVAWSSDSSRLVSASDDKTLKLWDVRSGKCLKTLKGHSNYVFCCNFNPPSNLIISGSFDETVKIWEVKTGKCLKTLSAHSDPVSAVHFNCSGSLIVSGSYDGLCRIWDAASGQCLKTLVDDDNPPVSFVKFSPNGKYILTATLDNTLKLWDYSRGRCLKTYTGHKNEKYCIFANFSVTGGKWIVSGSEDNLVYIWNLQTKEIVQKLQGHTDVVISAACHPTENLIASAALENDKTIKLWMSNH

SEQ ID NO: 17303 - protein, 1066 aa, Homo sapiens
MEPGKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDNKHREKSSTREKREKYSKEKSNSFSDKGEERHKEKRHKEGFHFDDERHQSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQNRKVSSLHTSRVQRQMVVSVHDLPEKSFVPLLDSKYVLCVWDIWQPSGPQKVLICESQVTCCCLSPLKAFLLFAGTAHGSVVVWDLREDSRLHYSVTLSDGFWTFRTATFSTDGILTSVNHRSPLQAVEPISTSVHKKQSFVLSPFSTQEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 17304 - protein, 305 aa, Homo sapiens
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGDDQEIHIYDCPI

SEQ ID NO: 17305 - protein, 305 aa, Homo sapiens; identical to SEQ ID NO: 17304

SEQ ID NO: 17306 - protein, 294 aa, Homo sapiens
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGD

SEQ ID NO: 17307 - protein, 891 aa, Homo sapiens
MAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKWTYPKNATTQYYPREFSEEEKETLKQSKPLVDFLNNASISVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVKTYQKSKEQMQAELKMDYESYLELEKTVLINLGLIKVTEKGSYMEVM

SEQ ID NO: 17308 - protein, 852 aa, Homo sapiens
MAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKCVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVKTYQKSKEQMQAELKMDYESYLELEKTVLINLGLIKVTEKGSYMEVM

SEQ ID NO: 17309 - protein, 852 aa, Homo sapiens; identical to SEQ ID NO: 17308

SEQ ID NO: 17310 - protein, 1081 aa, Homo sapiens
MDIRKEKRLNMALQMSNFKKALNRFEKLVEQTAAQKRDERAGLFIHKEDAIGYDKFYASVQKLFGPDVKNQDVKRFYRKLCNNTDASADWCEIFGYFSSEEDPIASQLDEENLVFFVSRKRRILISGSRRRDVIKSIVKIPHLDLLITATQKGLITVFNNQDTSWITGCDYLLQLKRIVATTERTIIVWDYKAQGSSQENYFVIKPMDHCLLCVCVVPLPDHLCRDDILLGDDGGFVNRFTVNSDDFGIKQAKSKRKLQNQVLDSKNFKSVKRKLHNDWVMKIRYISALNCFGSCSLDSNHSLVLESLKRLEDNLPVREFSMPRGANTFCYCVKANVIVTGGDDKVIRLWHPNISTKPVGKLVGHMFSIAEIVTNEKDQHVVSLSSAKVFRVWDIQTLSLLQVFHDSQGGPGDMQIYSMIYDANHGMLITGSSVMDMYPLTRMIQDTKQVPHTHEREINVMLYNKYFHQVLTICSESIIRVWELETGLQVYQILEPHGFNTEVTSAAVDESGFLFATGAYNGTVRIWDFGSGQEMKVLPEGKDWKEDEHCLRRLIFLKAQEKHQQLVLALERNGTIKMIQGKEDDIYLMVIWELPDVVPFLQDGKHAVHLRMSTRDRNMAIPFPDVELIVERNFSQPTDNPTMDLLRVNCIDLLQVEGYNLIAAGTLNGVIILWNFVTSTVKKVYRPEDCFTVNPDLHPKHFKINDILFLFRTPECARRSSQDSICSSSQCESSKGPQSSKGSKQSIHDSEVKGEQTDVMVGKQQPMDKKHPGIANLPEAQPPILVTAHEDGHLRLWTLEGRLLKDMLPFTKHSAISLTSLYTDSCTRILLAGNVEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKWRKMSSVSLLFKRTPPKAFEVEQDFKFFKSLSSPKIRRYPLEGFVTENREAGIVFGSLPIYSISSPTSLRFLPLIGVEAQKDSSDGITGKKKGGHVQREKAPRRRSLKKNLVPQINLASSFFPAIPK

SEQ ID NO: 17311 - protein, 914 aa, Homo sapiens
MDIRKEKRLNMALQMSNFKKALNRFEKLVEQTAAQKRDERAGLFIHKEDAIGYDKFYASVQKLFGPDVKNQDVKRFYRKLCNNTDASADWCEIFGYFSSEEDPIASQLDEENLVFFVSRKRRILISGSRRRDVIKSIVKIPHLDLLITATQKGLITVFNNQDTSWITGCDYLLQLKRIVATTERTIIVWDYKAQGSSQENYFVIKPMDHCLLCVCVVPLPDHLCRDDILLGDDGGFVNRFTVNSDDFGIKQAKSKRKLQNQVLDSKNFKSVKRKLHNDWVMKIRYISALNCFGSCSLDSNHSLVLESLKRLEDNLPVREFSMPRGANTFCYCVKANVIVTGGDDKVIRLWHPNISTKPVGKLVGHMFSIAEIVTNEKDQHVVSLSSAKVFRVWDIQTLSLLQVFHDSQGGPGDMQIYSMIYDANHGMLITGSSVMDMYPLTRMIQDTKQVPHTHEREINVMLYNKYFHQVLTICSESIIRVWELETGLQVYQILEPHGFNTEVTSAAVDESGFLFATGAYNGTVRIWDFGSGQEMKVLPEGKDWKEDEHCLRRLIFLKAQEKHQQLVLALERNGTIKMIQGKEDDIYLMVIWELPDVVPFLQDGKHAVHLRMSTRDRNMAIPFPDVELIVERNFSQPTDNPTMDLLRVNCIDLLQVEGYNLIAAGTLNEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKWRKMSSVSLLFKRTPPKAFEVEQDFKFFKSLSSPKIRRYPLEGFVTENREAGIVFGSLPIYSISSPTSLRFLPLIGVEAQKDSSDGITGKKKGGHVQREKAPRRRSLKKNLVPQINLASSFFPAIPK

SEQ ID NO: 17312 - protein, 1149 aa, Homo sapiens
MSDAAEAPREATGENGETEMKEEEEPNPNYKEVEDPQQESKDDTIAWRESQEEERKTGEEEGEEEGKEDKKIVMEETEEKAGEVQEKEASGIQEETTVEPQEVTASMIRLETQITDSQSITSGIFPKTQRGSKSKLSLQLEDAETDELLRDLSTQIEFLDLDQISPEEQQISSPERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWYEERDTLAHSAPLLTEKTFNKLVGKFSQSIFHLNLTQILSATMEGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKVGLQILPVDGNPHKTSAIVCHPNGVAGMAVSYDGCYAFTAGGHDRSVVQWKITLSVLEAAVSLGGEDLTPFYGLLSGGREGKFYRELEDYFYYSQLRSQGIDTMETRKVSEHICLSELPFVMRAIGFYPSEEKIDDIFNEIKFGEYVDTGKLIDKINLPDFLKVYLNHKPPFGNTMSGIHKSFEVLGYTNSKGKKAIRREDFLRLLVTKGEHMTEEEMLDCFASLFGLNPEGWKSEPATCSVKGSEICLEEELPDEITAEIFATEILGLTISEDSGQDGQ

SEQ ID NO: 17313 - protein, 941 aa, Homo sapiens
MSDAAEAPREATGENGETEMKEEEEPNPNYKEVEDPQQESKDDTIAWRESQEEERKTGEEEGEEEGKEDKKIVMEETEEKAGEVQEKEASGIQEETTVEPQEVTASMIRLETQITDSQSITSGIFPKTQRGSKSKLSLQLEDAETDELLRDLSTQIEFLDLDQISPEEQQISSPERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWYEERDTLAHSAPLLTEKTFNKLVGKFSQSIFHLNLTQILSATMEGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKVGLQILPVDGNPHKTSAIVCHPNGVAGMAVSYDGCYAFTAGGHDRSVVQWKITLSHPGSQAPILSPSDTSRS

SEQ ID NO: 17314 - protein, 415 aa, Homo sapiens
MKLKSLLLRYYPPGIMLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 17315 - protein, 400 aa, Homo sapiens
MLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 17316 - protein, 654 aa, Homo sapiens
MERSGPSEVTGSDASGPDPQLAVTMGFTGFGKKARTFDLEAMFEQTRRTAVERSRKTLEAREKEEEMNREKELRRQNEDIEPTSSRSNVVRDCSKSSSRDTSSSESEQSSDSSDDELIGPPLPPKMVGKPVNFMEEDILGPLPPPLNEEEEEAEEEEEEEEEEENPVHKIPDSHEITLKHGTKTVSALGLDPSGARLVTGGYDYDVKFWDFAGMDASFKAFRSLQPCECHQIKSLQYSNTGDMILVVSGSSQAKVIDRDGFEVMECIKGDQYIVDMANTKGHTAMLHTGSWHPKIKGEFMTCSNDATVRTWEVENPKKQKSVFKPRTMQGKKVIPTTCTYSRDGNLIAAACQNGSIQIWDRNLTVHPKFHYKQAHDSGTDTSCVTFSYDGNVLASRGGDDSLKLWDIRQFNKPLFSASGLPTMFPMTDCCFSPDDKLIVTGTSIQRGCGSGKLVFFERRTFQRVYEIDITDASVVRCLWHPKLNQIMVGTGNGLAKVYYDPNKSQRGAKLCVVKTQRKAKQAETLTQDYIITPHALPMFREPRQRSTRKQLEKDRLDPLKSHKPEPPVAGPGRGGRVGTHGGTLSSYIVKNIALDKTDDSNPREAILRHAKAAEDSPYWVSPAYSKTQPKTMFAQVESDDEEAKNEPEWKKRKI

SEQ ID NO: 17317 - protein, 378 aa, Homo sapiens
MDPGDDWLVESLRLYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSDVSDSEELSSLQVLDADTFAFCCASGRLGLVDTRQKWAPLENRSPGPGSGGERWCAEVGSWGQGPGPSIASLGSDGRLCLLDPRDLCHPVSSVQCPVSVPSPDPELLRVTWAPGLKNCLAISGFDGTVQVYDATSWDGTRSQDGTRSQVEPLFTHRGHIFLDGNGMDPAPLVTTHTWHPCRPRTLLSATNDASLHVWDWVDLCAPR

SEQ ID NO: 17318 - protein, 626 aa, Homo sapiens
MSRSGAAAEKADSRQRPQMKVNEYKENQNIAYVSLRPAQTTVLIKTAKVYLAPFSLSNYQLDQLMCPKSLSEKNSNNEVACKKTKIKKTCRRIIPPKMKNTSSKAESTLQNSSSAVHTESNKLQPKRTADAMNLSVDVESSQDGDSDEDTTPSLDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTIRHNTFTGRWLTRFQAMWDPKQEDCVIVGSMAHPRRVEIFHETGKRVHSFGGEYLVSVCSINAMHPTRYILAGGNSSGKIHVFMNEKSC

SEQ ID NO: 17319 - protein, 562 aa, Homo sapiens
MCPKSLSEKNSNNEVACKKTKIKKTCRRIIPPKMKNTSSKAESTLQNSSSAVHTESNKLQPKRTADAMNLSVDVESSQDGDSDEDTTPSLDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTIRHNTFTGRWLTRFQAMWDPKQEDCVIVGSMAHPRRVEIFHETGKRVHSFGGEYLVSVCSINAMHPTRYILAGGNSSGKIHVFMNEKSC

SEQ ID NO: 17320 - protein, 545 aa, Homo sapiens
MTPGKHSGASARAANGGAWGYRDFRGGQKKGWCTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMVTQTRIRSIFIWLLTKFS

SEQ ID NO: 17321 - protein, 848 aa, Homo sapiens
MTPGKHSGASARAANGGAWGYRDFRGGQKKGWCTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKDTNIYLAGTEEGHIHKCSCSYNEQYLDTYRGHKGPVYKVTWNPFCHDVFLSCSADWGVIIWQQENVKPSLSFYPATSVVYDVAWSPKSSYIFAAANENRVEIWDLHISTLDPLIVNTANPGIKFTTILFAKQTDCLLVGDSDGQVSVYELRNMPTVLETGRGDIMDTLLGSKSNQSA

SEQ ID NO: 17322 - protein, 561 aa, Homo sapiens
MVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKGPVYKVTWNPFCHDVFLSCSADWGVIIWQQENVKPSLSFYPATSVVYDVAWSPKSSYIFAAANENRVEIWDLHISTLDPLIVNTANPGIKFTTILFAKQTDCLLVGDSDGQVSVYELRNMPTVLETGRGDIMDTLLGSKSNQSA

SEQ ID NO: 17323 - protein, 890 aa, Homo sapiens
MDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 17324 - protein, 692 aa, Homo sapiens
MDGEPPASSGLGLPDYTSGVSFHDQADLPETEDFQAGLYVTESPQPQEAEAVSLGRLSDKSSTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 17325 - protein, 738 aa, Homo sapiens
MLVRVVLSLTPSFPEPSALYTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 17326 - protein, 572 aa, Homo sapiens
MGSLSSPTSTCPTSATWFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 17327 - protein, 1941 aa, Homo sapiens
MAQGSGGREGALRTPAGGWHSPPSPDMQELLRSVERDLSIDPRQLAPAPGGTHVVALVPARWLASLRDRRLPLGPCPRAEGLGEAEVRTLLQRSVQRLPAGWTRVEVHGLRKRRLSYPLGGGLPFEDGSCGPETLTRFMQEVAAQNYRNLWRHAYHTYGQPYSHSPAPSAVPALDSVRQALQRVYGCSFLPVGETTQCPSYAREGPCPPRGSPACPSLLRAEALLESPEMLYVVHPYVQFSLHDVVTFSPAKLTNSQAKVLFILFRVLRAMDACHRQGLACGALSLYHIAVDEKLCSELRLDLSAYERPEEDENEEAPVARDEAGIVSQEEQGGQPGQPTGQEELRSLVLDWVHGRISNFHYLMQLNRLAGRRQGDPNYHPVLPWVVDFTTPHGRFRDLRKSKFRLNKGDKQLDFTYEMTRQAFVAGGAGGGEPPHVPHHISDVLSDITYYVYKARRTPRSVLCGHVRAQWEPHEYPASMERMQNWTPDECIPEFYTDPSIFRSIHPDMPDLDVPAWCSSSQEFVAAHRALLESREVSRDLHHWIDLTFGYKLQGKEAVKEKNVCLHLVDAHTHLASYGVVQLFDQPHPQRLAGAPALAPEPPLIPKLLVQTIQETTGREDFTENPGQLPNGVGRPVLEATPCEASWTRDRPVAGEDDLEQATEALDSISLAGKAGDQLGSSSQASPGLLSFSVASASRPGRRNKAAGADPGEGEEGRILLPEGFNPMQALEELEKTGNFLAKGLGGLLEVPEQPRVQPAVPLQCLLHRDMQALGVLLAEMVFATRVRTLQPDAPLWVRFQAVRGLCTRHPKEVPVSLQPVLDTLLQMSGPEVPMGAERGKLDQLFEYRPVSQGLPPPCPSQLLSPFSSVVPFPPYFPALHRFILLYQARRVEDEAQGRELVFALWQQLGAVLKDITPEGLEILLPFVLSLMSEEHTAVYTAWYLFEPVAKALGPKNANKYLLKPLIGAYESPCQLHGRFYLYTDCFVAQLMVRLGLQAFLTHLLPHVLQVLAGAEASQEESKDLAGAAEEEESGLPGAGPGSCAFGEEIPMDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 17328 - protein, 714 aa, Homo sapiens
MVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 17329 - protein, 277 aa, Homo sapiens
MSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLECSRAAGTLAPGPSTRSLESCGGCSGATHSSSTASRCTARCSTPPRTTAPCASGTCAGSEVPRGPLRPCAASRGSSATRWAAPPRPCSRPDPAGPLQTPAQTPSGSQSAPPCYPRWWRPMAGEGRGARKPGREESPSQASGFSLVARRRWERECSPWGPPPFPF

SEQ ID NO: 17330 - protein, 376 aa, Homo sapiens
MGGGGSALRVCADHRGGINWLSLSPDGQRLLTGSEDGTARLWSTADGQCCALLQGHESYVTFCQLEDEAAFTCSADCTIRRWDVLTGQCLQVYRGHTSIVNRILVANNQLFSSSYDRTARVWSVDKGQMSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLELVNRLVYSGSADRTVKCWLADTGECVRTFTAHRRNVSALKYHAGTLFTGSGDACARAFDAQSGELRRVFRGHTFIINCIQVHGQVLYTASHDGALRLWDVRGLRGAPRPPPPMRSLSRLFSNKVGCAAAPLQPA

SEQ ID NO: 17331 - protein, 2873 aa, Homo sapiens
MSSPRLIPLWKDLKLLLNDTINKSKQPSEDPKNCLIVLSDRSQAVAWMKSKTEDMVEKRTFSMTERLPPIQSMVHAGSFHILVVYCGDLILRLFGDHFRAFKPLGKVPCRFNISCLCYDPEMKMLLSGILGAVVTWVIELGGTGLQIAHMVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQEFFFWHSRVRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRELAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPIEMEEASVYSQWSSSTSVIKLSKDVDSQEKDISKDHIALTLKRLQKIRDKRDKKATAQKLKKKHKKKGKEAKVINEETTPPVMEQPVTKKVKIQGRGASGISGRRSTAGDGSSWRDDLCRLMALRISGSQTKMSENLNAELVTFAQEMLVDRHPSWELFQEICPLLKKESKVLLEDLDWDVVPPEKKPIFIQEGAIREDMIQGVTQEVIRHKEVMPREEEQAQKKARDMLGLEETQVILKKGKKVIFLEPGNVTMGKEISKKEEKKTFQKSPKQGRKAVQKERKVGKIKREMTKEERDMSEEVEEMATLEEKVVKQEGKLVMIERTPSWQDWKKAWDEWKQVHGETRKSWKAWKEEWEKRLLQEEEKLHQAGEKLSPEEEMLQEDKKLKWEEWKQVWENMLSSKSKEQQYKDEEEVTLEEEVSREGEEKEQQVTEEQRHIQEEHKWARIHRKRARAEKKRAQEERKLAQEEEKLAQEERQLAQEERKLAQAYVKITQDDREMAQAEGKFAQKEETLAQRGEKLSQEAEKLAQKRKKLAKKWEKVAREEEKLAKKGGKLAEVKNILAQKVEELPQREQNLDWQEKELAQELEELEWDMEELSWKEEELNQEEGKLVEEKKKLAEEEEALAWQREKLSEEETKLAQEEELLIQEKEKLAQHKEKMPEEEERLGRKREQLIEKKMKLAQKRERWINSMEELTKNKMILYQKKNLAQEKKNLAQEKEKLAQRKENLLYNKERLTHSKKQLVQVKNKLGMFNKILAQVEEKLTQEKETVIKKKEKLAETEKKLVQVEDSLAKKQEKLAQEKMKLALEKAMVQGKKRLRGELDIAKEEKALNLEMKRLAEEKMRLVEGKETLSKGETPETSRQRKMTQVEQELFERKLSLEEKILLHEDRILAMEESEIAKGKLEFTRGQRIFVQGQRKLAKASRKLIKKRESLSKEPAKLNKILKALQKLTRDERKLTQEEIKMTKMKRALFVKERRLSIEQSKLDIKEWDFSEKRSELTKDEKKLARKQRKLANKMRRMINKEEKMTEEESKLARKHSEVILDDEEEGGIEEEEVIPFLKRRWRKRKEAKRGDKPKEKFSSQVDEVESEEHFSEEMESLLDELEKQESLSSEEEEEREEEEEREEEEVREEEEERKEEEEGEEKQVEKEEEEKKKKKKEKKKEEVQEKEEVFEEKEEIMSEEETESLSDEEEEEESCSLEEEVDREKEILKKEKQFKLQEQRRKSLRGRERVLSILRGVPHGKGRAIRLGVLKSPLKKLMSTALEMKEKTPVPVPEKQISWEDKKATVVEIPRKFLGTMDKEREVMGKYEPIPPHVLGTVLESQAQDLKTPFMSHILRRTVEAEELQHKPLGAWWKWFLQHPPLMGQTEVQLPLSQIPAKEQHADVSLSDVEWIRHVLERMEAGEQLSRDGFHRLCQLLKDLASKGNLEWLHLAKHEAIVYRHRQALESQDTRISSRQSMSPKYLKVIPPIKAKEKESWPKPLAVPTQKSPLATKRIPDPRAKNWHLLGEPYRSERAQQISIAHKEMEMQYFYPATRDIFPSAHASVEKQTLALMFQKDFWDFKDKRRFPKLPKLEKKTQPISKKKEELPLWETFVALYHVLRMLQQRYPKDSTAWMEQFYQLMDLYQLKSPRIQKLLQELLMREEPQPQEIIYEEALKATELVPGERLFCCLFCGSSHTPRSPQEFQGAVPLPWQNCVRTILPVGIARYGILELAWKSLPEADLHLTKALTHTVAPTL

SEQ ID NO: 17332 - protein, 2912 aa, Homo sapiens
MSSPRLIPLWKDLKLLLNDTINKSKQPSEDPKNCLIVLSDRSQVLFKESRYPQNMPCVCYYFSDAHFFASLSWVTSNTKEIQAVAWMKSKTEDMVEKRTFSMTERLPPIQSMVHAGSFHILVVYCGDLILRLFGDHFRAFKPLGKVPCRFNISCLCYDPEMKMLLSGILGAVVTWVIELGGTGLQIAHMVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQEFFFWHSRVRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRELAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPIEMEEASVYSQWSSSTSVIKLSKDVDSQEKDISKDHIALTLKRLQKIRDKRDKKATAQKLKKKHKKKGKEAKVINEETTPPVMEQPVTKKVKIQGRGASGISGRRSTAGDGSSWRDDLCRLMALRISGSQTKMSENLNAELVTFAQEMLVDRHPSWELFQEICPLLKKESKVLLEDLDWDVVPPEKKPIFIQEGAIREDMIQGVTQEVIRHKEVMPREEEQAQKKARDMLGLEETQVILKKGKKVIFLEPGNVTMGKEISKKEEKKTFQKSPKQGRKAVQKERKVGKIKREMTKEERDMSEEVEEMATLEEKVVKQEGKLVMIERTPSWQDWKKAWDEWKQVHGETRKSWKAWKEEWEKRLLQEEEKLHQAGEKLSPEEEMLQEDKKLKWEEWKQVWENMLSSKSKEQQYKDEEEVTLEEEVSREGEEKEQQVTEEQRHIQEEHKWARIHRKRARAEKKRAQEERKLAQEEEKLAQEERQLAQEERKLAQAYVKITQDDREMAQAEGKFAQKEETLAQRGEKLSQEAEKLAQKRKKLAKKWEKVAREEEKLAKKGGKLAEVKNILAQKVEELPQREQNLDWQEKELAQELEELEWDMEELSWKEEELNQEEGKLVEEKKKLAEEEEALAWQREKLSEEETKLAQEEELLIQEKEKLAQHKEKMPEEEERLGRKREQLIEKKMKLAQKRERWINSMEELTKNKMILYQKKNLAQEKKNLAQEKEKLAQRKENLLYNKERLTHSKKQLVQVKNKLGMFNKILAQVEEKLTQEKETVIKKKEKLAETEKKLVQVEDSLAKKQEKLAQEKMKLALEKAMVQGKKRLRGELDIAKEEKALNLEMKRLAEEKMRLVEGKETLSKGETPETSRQRKMTQVEQELFERKLSLEEKILLHEDRILAMEESEIAKGKLEFTRGQRIFVQGQRKLAKASRKLIKKRESLSKEPAKLNKILKALQKLTRDERKLTQEEIKMTKMKRALFVKERRLSIEQSKLDIKEWDFSEKRSELTKDEKKLARKQRKLANKMRRMINKEEKMTEEESKLARKHSEVILDDEEEGGIEEEEVIPFLKRRWRKRKEAKRGDKPKEKFSSQVDEVESEEHFSEEMESLLDELEKQESLSSEEEEEREEEEEREEEEVREEEEERKEEEEGEEKQVEKEEEEKKKKKKEKKKEEVQEKEEVFEEKEEIMSEEETESLSDEEEEEESCSLEEEVDREKEILKKEKQFKLQEQRRKSLRGRERVLSILRGVPHGKGRAIRLGVLKSPLKKLMSTALEMKEKTPVPVPEKQISWEDKKATVVEIPRKFLGTMDKEREVMGKYEPIPPHVLGTVLESQAQDLKTPFMSHILRRTVEAEELQHKPLGAWWKWFLQHPPLMGQTEVQLPLSQIPAKEQHADVSLSDVEWIRHVLERMEAGEQLSRDGFHRLCQLLKDLASKGNLEWLHLAKHEAIVYRHRQALESQDTRISSRQSMSPKYLKVIPPIKAKEKESWPKPLAVPTQKSPLATKRIPDPRAKNWHLLGEPYRSERAQQISIAHKEMEMQYFYPATRDIFPSAHASVEKQTLALMFQKDFWDFKDKRRFPKLPKLEKKTQPISKKKEELPLWETFVALYHVLRMLQQRYPKDSTAWMEQFYQLMDLYQLKSPRIQKLLQELLMREEPQPQEIIYEEALKATELVPGERLFCCLFCGSSHTPRSPQEFQGAVPLPWQNCVRTILPVGIARYGILELAWKSLPEADLHLTKALTHTVAPTL

SEQ ID NO: 17333 - protein, 472 aa, Homo sapiens
MASPPRCSPTAHDRECKLPPPSAPASEYCPGKLSWGTMARALGRFKLSIPHTHLLATLDPLALDREPPPHLLPEKHQVPEKLIWGDQDPLSKIPFKILSGHEHAVSTCHFCVDDTKLLSGSYDCTVKLWDPVDGSVVRDFEHRPKAPVVECSITGDSSRVIAASYDKTVRAWDLETGKLLWKVRYDTFIVSCKFSPDGKYVVSGFDVDHGICIMDAENITTVSVIKDHHTRSITSCCFDPDSQRVASVSLDRCIKIWDVTSQATLLTITKAHSNAISNCCFTFSGHFLCTSSWDKNLKIWNVHTGEFRNCGACVTLMQGHEGSVSSCHFARDSSFLISGGFDRTVAIWDVAEGYRKLSLKGHNDWVMDVAISNNKKWILSASKDRTMRLWNIEEIDEIPLVIKYKKAVGLKLKQCERCDRPFSIFKSDTSSEMFTQCVFCRIDTRGLPADTSSSSSSSERENSPPPRGSKDD

SEQ ID NO: 17334 - protein, 426 aa, Homo sapiens
MASPPRCSPTAHDRECKLPPPSAPASEYCPGKLSWGTMARALGRFKLSIPHTHLLATLDPLALDREPPPHLLPEKHQVPEKLIWGDQDPLSKIPFKILSGHEHAVSTCHFCVDDTKLLSGSYDCTVKLWDPVDGSVVRDFEHRPKAPVVECSITGDSSRVIAASYDKTVRAWDLETGKLLWKVRYDTFIVSCKFSPDGKYVVSGFDVDHGICIMDAENITTVSVIKDHHTRSITSCCFDPDSQRVASVSLDRCIKIWDVTSQATLLTITKAHSNAISNCCFTFSGHFLCTSSWDKNLKIWNVHTGEFRNCGACVTLMQGHEGSVSSCHFARDSSFLISGGFDRTVAIWDVAEGYRKLSLKGHNDWVMDVAISNNKKWILSASKDRTMRLWNIEEIDEIPLVIKYKKAVGLKLKQEKKEAYLKLKQG

SEQ ID NO: 17335 - protein, 387 aa, Homo sapiens
MEKIEEQFANLHIVKCSLGTKEPTYLLGIDTSKTVQAGKENLVAVLCSNGSIRIYDKERLNVLREFSGYPGLLNGVRFANSCDSVYSACTDGTVKCWDARVAREKPVQLFKGYPSNIFISFDINCNDHIICAGTEKVDDDALLVFWDARMNSQNLSTTKDSLGAYSETHSDDVTQVRFHPSNPNMVVSGSSDGLVNVFDINIDNEEDALVTTCNSISSVSCIGWSGKGYKQIYCMTHDEGFYWWDLNHLDTDEPVTRLNIQDVREVVNMKEDALDYLIGGLYHEKTDTLHVIGGTNKGRIHLMNCSMSGLTHVTSLQGGHAATVRSFCWNVQDDSLLTGGEDAQLLLWKPGAIEKTFTKKESMKIASSVHQRVRVHSNDSYKRRKKQ

SEQ ID NO: 17336 - protein, 387 aa, Homo sapiens; identical to SEQ ID NO: 17335

SEQ ID NO: 17337 - protein, 299 aa, Homo sapiens
MLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 17338 - protein, 1748 aa, Homo sapiens
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSSTRLPEPVHGVAFNPWDAGELTCVGQGTVTFWLLQQRGADISLQVRREPVPEAVGAGELTSLCYGAPPLLYCGTSSGQVCVWDTRAGRCFLSWEADDGGIGLLLFSGSRLVSGSSTGRLRLWAVGAVSELRCKGSGASSVFMEHELVLDGAVVSASFDDSVDMGVVGTTAGTLWFVSWAEGTSTRLISGHRSKVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 17339 - protein, 636 aa, Homo sapiens
MAEAVERTDELVREYLLFRGFTHTLRQLDAEIKADKEKGFRVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELAMVCSQRNASLSQSPRVGFLSSLLPQSKKSPSRLSPAQGPPQPQSSAKKESFGGQGTKGKDPTSGAKDGKSLLSGLATGESGWSQHRQRRLQDHGKERKELFSTTTSQCAEKKPEASGPEAEPCPELHTEPVEPLTRASSAGPEGGGVRPEQPFIVLGQEEYGEHHSSIMHCRVDCSGRRVASLDVDGVIKVWSFNPIMQTKASSISKSPLLSLEWATKRDRLLLLGSGVGTVRLYDTEAKKNLCEININDNMPRILSLACSPNGASFVCSAAAPSLTSQVDFSAPDIGSKGMNQVPGRLLLWDTKTMKQQLQFSLDPEPIAINCTAFNHNGNLLVTGAADGVIRLFVHPVEHPQEWPQGIRVQPPLRCHGPLCAVWIQRLQAGSSPQGPTLRF

SEQ ID NO: 17340 - protein, 747 aa, Homo sapiens
MAEAVERTDELVREYLLFRGFTHTLRQLDAEIKADKEKGFRVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELAMVCSQRNASLSQSPRVGFLSSLLPQSKKSPSRLSPAQGPPQPQSSAKKESFGGQGTKGKDPTSGAKDGKSLLSGLATGESGWSQHRQRRLQDHGKERKELFSTTTSQCAEKKPEASGPEAEPCPELHTEPVEPLTRASSAGPEGGGVRPEQPFIVLGQEEYGEHHSSIMHCRVDCSGRRVASLDVDGVIKVWSFNPIMQTKASSISKSPLLSLEWATKRDRLLLLGSGVGTVRLYDTEAKKNLCEININDNMPRILSLACSPNGASFVCSAAAPSLTSQVDFSAPDIGSKGMNQVPGRLLLWDTKTMKQQLQFSLDPEPIAINCTAFNHNGNLLVTGAADGVIRLFDMQQHECAMSWRAHYGEVYSVEFSYDENTVYSIGEDGKFIQWNIHKSGLKVSEYSLPSDATGPFVLSGYSGYKQVQVPRGRLFAFDSEGNYMLTCSATGGVIYKLGGDEKVLESCLSLGGHRAPVVTVDWSTAMDCGTCLTASMDGKIKLTTLLAHKA

SEQ ID NO: 17341 - protein, 870 aa, Homo sapiens
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKVLF

SEQ ID NO: 17342 - protein, 1665 aa, Homo sapiens
MAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKSQTSEAVRKSREDLDVCKEHYDNLLAEDKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 17343 - protein, 303 aa, Homo sapiens
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKVCWMVIS

SEQ ID NO: 17344 - protein, 412 aa, Homo sapiens
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVV

SEQ ID NO: 17345 - protein, 1637 aa, Homo sapiens
MAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 17346 - protein, 997 aa, Homo sapiens
  MOD_RES (1)..(1): Any amino acid
XPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 17347 - protein, 514 aa, Homo sapiens
  MOD_RES (1)..(1): Any amino acid
XWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKSQTSEAVRKSREDLDVCKEHYDNLLAEDKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 17348 - protein, 654 aa, Homo sapiens
MAPLVPGPPLEASPTTLDAAVRWGLQRPVRGHMAPGQAGGRGDASALGAQYSWARDGRSAVGSKLSWVGPAAPESKAAQGREMGRDVGKAVDCLDLSGPDGASCLQLSLRKSELFPAARRPGRPADPGLSPRCLRRPPLRPGPASTPLRGPGAARPPPLPPHSRGRSAVSFLAFLPPQRSPSAPREAAGSRGGLRASGGRCGGPAGAAAGSGGGGDAPGPAGRAMQRSRAGADEAALLLAGLALRELEPGCGSPGRGRRGPRPGPGDEAAPALGRRGKGSGGPEAGADGLSRGERGPRRAAVPELSAQPAGSPRASLAGSDGGGGGGSARSSGISLGYDQRHGSPRSGRSDPRPGPGPPSVGSARSSVSSLGSRGSAGAYADFLPPGACPAPARSPEPAGPAPFPLPALPLPPGREGGPSAAERRLEALTRELERALEARTARDYFGICIKCGLGIYGAQQACQAMGSLYHTDCFTCDSCGRRLRGKAFYNVGEKVYCQEDFLYSGFQQTADKCSVCGHLIMEMILQALGKSYHPGCFRCSVCNECLDGVPFTVDVENNIYCVRDYHTVFAPKCASCARPILPAQGCETTIRVVSMDRDYHVACYHCEDCGLQLSGEEGRRCYPLAGHLLCRRCHLRRLQPGPLPSPTVHVTEL

SEQ ID NO: 17349 - protein, 1800 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGGGYFGLSFTCPSLKNPISKKSWTRKLKSWAYRLRQSTSFFKRSKVRQVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATGKSCLINELENPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 17350 - protein, 354 aa, Homo sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 17351 - protein, 712 aa, Homo sapiens
MLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRKNFTFVTAITHGVCLPLPVPMPSFA

SEQ ID NO: 17352 - protein, 1192 aa, Homo sapiens
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 17353 - protein, 1216 aa, Homo sapiens
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLNTYFLCCWELKDDVFTRLTVKPLLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 17354 - protein, 320 aa, Homo sapiens
MPRLRVHGACLPTKSVLFLFYHRLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 17355 - protein, 1143 aa, Homo sapiens
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDYVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 17356 - protein, 104 aa, Homo sapiens
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 17357 - protein, 104 aa, Homo sapiens; identical to SEQ ID NO: 17356

SEQ ID NO: 17358 - protein, 1092 aa, Homo sapiens
MDHINKLTQIEDPREQWRREQERMLKEYLIVAQEALNAKKEIYQIKQQRFELAQEEYQQLHKMCEDDSRSYASSFSGYSTNTKYDPHQIKAEIASRRDRLSRLKRELTQMKQELQYKEKGVETLQEIDRKMSSTHTSYKLDEAQAIMSELRTIKKAICTGEKERRDLMHSLAKLTDSFKNSCSVTDSLVDFPHHVGVPGDAGVPQQFCDAGSQTDIIGEFVFDDKTRLVDRVRLNWQYEEARKRVANIQQQLARLDNESWPSTAEADRDRLQLIKEKEALLQELQLIIAQRRSAGDVARLEEERERLEEELRRARATSAQGATERILLQEKRNCLLMQLEEATRLTSYLQSQLKSLCASTLTVSSGSSRGSLASSRGSLASSRGSLSSVSFTDIYGLPQYEKPDAEGSQLLRFDLIPFDSLGRDAPFSEPPGPSGFHKQRRSLDTPQSLASLSSRSSLSSLSPPSSPLDTPFLPASRDSPLAQLADSCEGPGLGALDRLRAHASAMGDEDLPGMAALQPHGVPGDGEGPHERGPPPASAPVGGTVTLREDSAKRLERRARRISACLSDYSLASDSGVFEPLTKRNEDAEEPAYGDTASNGDPQIHVGLLRDSGSECLLVHVLQLKNPAGLAVKEDCKVHIRVYLPPLDSGTPNTYCSKALEFQVPLVFNEVFRIPVHSSALTLKSLQLYVCSVTPQLQEELLGIAQINLADYDSLSEMQLRWHSVQVFTSSEPSRTREAGCAGESSARDPAHTISISGKTDAVTVLLARTTAQLQAVERELAEERAKLEYTEEEVLEMERKEEQAEAISERSWQADSVDSGCSNCTQTSPPYPEPCCMGIDSILGHPFAAQAGPYSPEKFQPSPLKVDKETNTEDLFLEEAASLVKERPSRRARGSPFVRSGTIVRSQTFSPGARSQYVCRLYRSDSDSSTLPRKSPFVRNTLERRTLRYKQSCRSSLAELMARTSLDLELDLQASRTRQRQLNEELCALRELRQRLEDAQLRGQTDLPPWVLRDERLRGLLREAERQTRQTKLDYRHEQAAEKMLKKASKEIYQLRGQSHKEPIQVQTFREKIAFFTRPRINIPPLPADDV

SEQ ID NO: 17359 - protein, 582 aa, Homo sapiens
LSHISELTQIEDPREQWRREQERMLKEYLIVAQEALNAKKEIYQIKQQRFELAQEEYQQLHKMCEDDSRSYASSFSGYSTNTKYDPHQIKAEIASRRDRLSRLKRELTQMKQELQYKEKGVETLQEIDRKMSSTHTSYKLDEAQAIMSELRTIKKAICTGEKERRDLMHSLAKLTDSFKNSCSVTDSLVDFPHHVGVPGDAGVPQQFCDAGSQTDIIGEFVFDDKTRLVDRVRLNWQYEEARKRVANIQQQLARLDNESWPSTAEADRDRLQLIKEKEALLQELQLIIAQRRSAGDVARLEEERERLEEELRRARATSAQGATERILLQEKRNCLLMQLEEATRLTSYLQSQLKSLCASTLTVSSGSSRGSLASSRGSLASSRGSLSSVSFTDIYGLPQYEKPDAEGSQLLRFDLIPFDSLGRDAPFSEPPGPSGFHKQRRSLDTPQSLASLSSRSSLSSLSPPSSPLDTPFLPASRDSPLAQLADSCEGPGLGALDRLRAHASAMGDEDLPGMAALQPHGVPGDGEGPHERGPPPASAPVGGSKCGCSDSSRRQCQEVGEEGTPHLRMSVGLFASQRQWGV

SEQ ID NO: 17360 - protein, 1092 aa, Homo sapiens; identical to SEQ ID NO: 17358

SEQ ID NO: 17361 - protein, 212 aa, Homo sapiens
MQLEEATRLTSYLQSQLKSLCASTLTVSSGSSRGSLASSRGSLASSRGSLSSVSFTDIYGLPQYEKPDAEGSQLLRFDLIPFDSLGRDAPFSEPPGPSGFHKQRRSLDTPQSLASLSSRSSLSSLSPPSSPLDTPFLPASRDSPLAQLADSCEGPGLGALDRLRAHASAMGDEDLPGMAALQPHGVPGDGEGPHERGPPPASAPVGGKILTS

SEQ ID NO: 17362 - protein, 587 aa, Homo sapiens [sequence omitted]

SEQ ID NO: 17363 - protein, 69 aa, Homo sapiens
MESPKKKNQQLKVGILHLGSRQKKIRIQLRSQVLGREMRDMEGDLQELHQSNTGDKSGFGFRRQGEDNT

SEQ ID NO: 17364 - protein, 146 aa, Homo sapiens
MLLWCPPQCACSLGVFPSAPSPVWGTRRSCEPATRVPEVWILSPLLRHGGHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 17365 - protein, 146 aa, Homo sapiens; identical to SEQ ID NO: 17364

SEQ ID NO: 17366 - protein, 69 aa, Homo sapiens; identical to SEQ ID NO: 17363

SEQ ID NO: 17367 - protein, 111 aa, Homo sapiens
MIWRGRSTYRPRPRRSVPPPELIGPMLEPGDEEPQQEEPPTESRDPAPGQEREEDQGAAETQVPDLEADLQELSQSKTGGECGNGPDDQGKILPKSEQFKMPEGGDRQPQV

SEQ ID NO: 17368 - protein, 111 aa, Homo sapiens; identical to SEQ ID NO: 17367

SEQ ID NO: 17369 - protein, 108 aa, Homo sapiens
MSWRGRRYRPRRCLRLAQLVGPMLEPSVPEPQQEEPPTESQDHTPGQKREDDQGAAEIQVPNLEADLQELSQSKTGDECGDSPDVQGKILPKSEQFKMPEGGEGKPQL

SEQ ID NO: 17370 - protein, 81 aa, Homo sapiens
MESPKKKNQQLKVGILHLGSRQKKIRIQLRSQCATWKVICKSCISQTPGINLDLGSGVKVKIIPKEEHCKMPEAGEEQPQV

SEQ ID NO: 17371 - protein, 146 aa, Homo sapiens; identical to SEQ ID NO: 17364

SEQ ID NO: 17372 - protein, 69 aa, Homo sapiens; identical to SEQ ID NO: 17363

SEQ ID NO: 17373 - protein, 111 aa, Homo sapiens
MSWRGRSTYRPRPRRSLQPPELIGAMLEPTDEEPKEEKPPTKSRNPTPDQKREDDQGAAEIQVPDLEADLQELCQTKTGDGCEGGTDVKGKILPKAEHFKMPEAGEGKSQV

SEQ ID NO: 17374 - protein, 111 aa, Homo sapiens; identical to SEQ ID NO: 17373

SEQ ID NO: 17375 - protein, 108 aa, Homo sapiens; identical to SEQ ID NO: 17369

SEQ ID NO: 17376 - protein, 108 aa, Homo sapiens; identical to SEQ ID NO: 17369

SEQ ID NO: 17377 - protein, 75 aa, Homo sapiens
MSWRGRRYRPRRCLRLAQLVGPMLEPSVPEPQQEEPPTESQDHTPGQKREDDQGAAEIQGTSILAQDKTQFSETG

SEQ ID NO: 17378 - protein, 108 aa, Homo sapiens; identical to SEQ ID NO: 17369

SEQ ID NO: 17379 - protein, 89 aa, Homo sapiens
MKYTKQNFMMSVLGIIIYVTDLIVDIWVSVRFFHEGQYVFSALALSFMLFGTLVAQCFSYSWFKADLKKAGQESQHCFLLLHCLQGGVF

SEQ ID NO: 17380 - protein, 226 aa, Homo sapiens
MSWVQAASLIQGPGDKGDVFDEEADESLLAQREWQSNMQRRVKEGYRDGIDAGKAVTLQQGFNQGYKKGAEVILNYGRLRGTLSALLSWCHLHNNNSTLINKINNLLDAVGQCEEYVLKHLKSITPPSHVVDLLDSIEDMDLCHVVPAEKKIDEAKDERLCENNAEFNKNCSKSHSGIDCSYVECCRTQEHAHSENPSPTWILEQTASLVKQLGLSVDVLQHLKQL

SEQ ID NO: 17381 - protein, 206 aa, Homo sapiens
MSWVQAASLIQGPGDKGDVFDEEADESLLAQREWQSNMQRRVKEGYRDGIDAGKAVTLQQGFNQGYKKGAEVILNYGRLRGTLRNSTDWSLLGLRAPLRSPEVGTQLLPRPLPVPGHMASGATPKQPTELEATLLSLVPQSGRATPRFPARLRAPGPGTPSHRRRFRRKPHRDPAAACPAWPPEAPSNSETHFSTYNRIIIRGGHI

SEQ ID NO: 17382 - protein, 323 aa, Homo sapiens
MSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVREELEAQLSCFRELLGRAPTHADGHQHVHVLPGVCQVFAEALQAYGVRFTRLPLERGVGGCTWLEAPARAFACAVERDARAAVGPFSRHGLRWTDAFVGLSTCGRHMSAHRVSGALARVLEGTLAGHTLTAELMAHPGYPSVPPTGGCGEGPDAFSCSWERLHELRVLTAPTLRAQLAQDGVQLCALDDLDSKRPGEEVPCEPTLEPFLEPSLL

SEQ ID NO: 17383 - protein, 149 aa, Homo sapiens
MSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVREELEAQLSCFRELLGRAPTHADGHQHVHVLPGGQTPSWA

SEQ ID NO: 17384 - protein, 299 aa, Homo sapiens
MSSAAGPDPSEAPEERHFLRALELQPPLADMGRAELSSNATTSLVQRRKQAWGRQSWLEQIWNAGPVCQSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 17385 - protein, 249 aa, Homo sapiens
MSSAAGPDPSEAPEERHFLSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 17386 - protein, 249 aa, Homo sapiens; identical to SEQ ID NO: 17385

SEQ ID NO: 17387 - protein, 299 aa, Homo sapiens; identical to SEQ ID NO: 17384

SEQ ID NO: 17388 - protein, 273 aa, Homo sapiens
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGMPGRGGHIGAWGAWVEAPVPQLLVAPACLNLNLPSLDGPTLG

SEQ ID NO: 17389 - protein, 168 aa, Homo sapiens
MEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTR

SEQ ID NO: 17390 - protein, 1215 aa, Homo sapiens
MSSMPKPERHAESLLDICHDTNSSPTDLMTVTKNQNIILQSISRSEEFDQDGDCSHSTLVNEEEDPSGGRQDWQPRTEEFSTSHMKYSGRSIKFLLPPLSLLPTRSGVLTIPQNHKFPKEKERNIPSLTSFVPKLSVSVRQSDELSPSNEPPGALVKSLMDPTLRSSDGFIWSRNMCSFPKTNHHRQCLEKEENWKSKEIEECNKIEITHFEKGQSLVSFENLKEGNIPAVREEDIDCHGSKTRKPEEENSQYLSSRKNESSVAKNYEQDPEIVCTIPSKFQETQHSEITPSQDEEMRNNKAASKRVSLHKNEAMEPNNILEECTVLKSLSSVVFDDPIDKLPEGCSSMETNIKISIAERAKPEMSRMVPLIHITFPVDGSPKEPVIAKPSLQTRKGTIHNNHSVNIPVHQENDKHKMNSHRSKLDSKTKTSKKTPQNFVISTEGPIKPTMHKTSIKTQIFPALGLVDPRPWQLPRFQKKMPQIAKKQSTHRTQKPKKQSFPCICKNPGTQKSCVPLSVQPTEPRLNYLDLKYSDMFKEINSTANGPGIYEMFGTPVYCHVRETERDENTYYREICSAPSGRRITNKCRSSHSERKSNIRTRLSQKKTHMKCPKTSFGIKQEHKVLISKEKSSKAVHSNLHDIENGDGISEPDWQIKSSGNEFLSSKDEIHPMNLAQTPEQSMKQNEFPPVSDLSIVEEVSMEESTGDRDISNNQILTTSLRDLQELEELHHQIPFIPSEDSWAVPSEKNSNKYVQQEKQNTASLSKVNASRILTNDLEFDSVSDHSKTLTNFSFQAKQESASSQTYQYWVHYLDHDSLANKSITYQMFGKTLSGTNSISQEIMDSVNNEELTDELLGCLAAELLALDEKDNNSCQKMANETDPENLNLVLRWRGSTPKEMGRETTKVKIQRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 17391 - protein, 510 aa, Homo sapiens
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 17392 - protein, 1328 aa, Homo sapiens
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKFLLPPLSLLPTRSGVLTIPQNHKFPKEKERNIPSLTSFVPKLSVSVRQSDELSPSNEPPGALVKSLMDPTLRSSDGFIWSRNMCSFPKTNHHRQCLEKEENWKSKEIEECNKIEITHFEKGQSLVSFENLKEGNIPAVREEDIDCHGSKTRKPEEENSQYLSSRKNESSVAKNYEQDPEIVCTIPSKFQETQHSEITPSQDEEMRNNKAASKRVSLHKNEAMEPNNILEECTVLKSLSSVVFDDPIDKLPEGCSSMETNIKISIAERAKPEMSRMVPLIHITFPVDGSPKEPVIAKPSLQTRKGTIHNNHSVNIPVHQENDKHKMNSHRSKLDSKTKTSKKTPQNFVISTEGPIKPTMHKTSIKTQIFPALGLVDPRPWQLPRFQKKMPQIAKKQSTHRTQKPKKQSFPCICKNPGTQKSCVPLSVQPTEPRLNYLDLKYSDMFKEINSTANGPGIYEMFGTPVYCHVRETERDENTYYREICSAPSGRRITNKCRSSHSERKSNIRTRLSQKKTHMKCPKTSFGIKQEHKVLISKEKSSKAVHSNLHDIENGDGISEPDWQIKSSGNEFLSSKDEIHPMNLAQTPEQSMKQNEFPPVSDLSIVEEVSMEESTGDRDISNNQILTTSLRDLQELEELHHQIPFIPSEDSWAVPSEKNSNKYVQQEKQNTASLSKVNASRILTNDLEFDSVSDHSKTLTNFSFQAKQESASSQTYQYWVHYLDHDSLANKSITYQMFGKTLSGTNSISQEIMDSVNNEELTDELLGCLAAELLALDEKDNNSCQKMANETDPENLNLVLRWRGSTPKEMGRETTKVKIQRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 17393 - protein, 460 aa, Homo sapiens
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 17394 - protein, 462 aa, Homo sapiens
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKRHSSGLRIYDREEKFLISNEKKIFSENSLKSEEPILWTKVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 17395 - protein, 697 aa, Homo sapiens
KQSFPCICKNPGTQKSCVPLSVQPTEPRLNYLDLKYSDMFKEINSTANGPGIYEMFGTPVYCHVRETERDENTYYREICSAPSGRRITNKCRSSHSERKSNIRTRLSQKKTHMKCPKTSFGIKQEHKVLISKEKSSKAVHSNLHDIENGDGISEPDWQIKSSGNEFLSSKDEIHPMNLAQTPEQSMKQNEFPPVSDLSIVEEVSMEESTGDRDISNNQILTTSLRDLQELEELHHQIPFIPSEDSWAVPSEKNSNKYVQQEKQNTASLSKVNASRILTNDLEFDSVSDHSKTLTNFSFQAKQESASSQTYQYWVHYLDHDSLANKSITYQMFGKTLSGTNSISQEIMDSVNNEELTDELLGCLAAELLALDEKDNNSCQKMANETDPENLNLVLRWRGSTPKEMGRETTKVKIQRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTR

SEQ ID NO: 17396 - protein, 1430 aa, Homo sapiens
MSRPSSVSPRQPAPGGGGGGGPSPCGPGGGGRAKGLKDIRIDEEVKIAVNIALERFRYGDQREMEFPSSLTSTERAFIHRLSQSLGLVSKSKGKGANRYLTVKKKDGSETAHAMMTCNLTHNTKHAVRSLIQRFPVTNKERTELLPKTERGNVFAVEAENREMSKTSGRLNNGIPQIPVKRGESEFDSFRQSLPVFEKQEEIVKIIKENKVVLIVGETGSGKTTQIPQFLLDDCFKNGIPCRIFCTQPRRLAAIAVAERVAAERRERIGQTIGYQIRLESRVSPKTLLTFCTNGVLLRTLMAGDSTLSTVTHVIVDEVHERDRFSDFLLTKLRDLLQKHPTLKLILSSAALDVNLFIRYFGSCPVIYIQGRPFEVKEMFLEDILRTTGYTNKEMLKYKKEKQQEEKQQTTLTEWYSAQENSFKPESQRQRTVLNVTDEYDLLDDGGDAVFSQLTEKDVNCLEPWLIKEMDACLSDIWLHKDIDAFAQVFHLILTENVSVDYRHSETSATALMVAAGRGFASQVEQLISMGANVHSKASNGWMALDWAKHFGQTEIVDLLESYSATLEFGNLDESSLVQTNGSDLSAEDRELLKAYHHSFDDEKVDLDLIMHLLYNICHSCDAGAVLIFLPGYDEIVGLRDRILFDDKRFADSTHRYQVFMLHSNMQTSDQKKVLKNPPAGVRKIILSTNIAETSITVNDVVFVIDSGKVKEKSFDALNFVTMLKMVWISKASAIQRKGRAGRCRPGICFRLFSRLRFQNMLEFQTPELLRMPLQELCLHTKLLAPVNCPIADFLMKAPEPPPALIVRNAVQMLKTIDAMDTWEDLTELGYHLADLPVEPHLGKMVLCAVVLKCLDPILTIACTLAYRDPFVLPTQASQKRAAMLCRKRFTAGAFSDHMALLRAFQAWQKARSDGWERAFCEKNFLSQATMEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQELEPLVGEQLLQLWERLPLGEKNTTD

SEQ ID NO: 17397 - protein, 1340 aa, Homo sapiens
MLRKGANRYLTVKKKDGSETAHAMMTCNLTHNTKHAVRSLIQRFPVTNKERTELLPKTERGNVFAVEAENREMSKTSGRLNNGIPQIPVKRGESEFDSFRQSLPVFEKQEEIVKIIKENKVVLIVGETGSGKTTQIPQFLLDDCFKNGIPCRIFCTQPRRLAAIAVAERVAAERRERIGQTIGYQIRLESRVSPKTLLTFCTNGVLLRTLMAGDSTLSTVTHVIVDEVHERDRFSDFLLTKLRDLLQKHPTLKLILSSAALDVNLFIRYFGSCPVIYIQGRPFEVKEMFLEDILRTTGYTNKEMLKYKKEKQQEEKQQTTLTEWYSAQENSFKPESQRQRTVLNVTDEYDLLDDGGDAVFSQLTEKDVNCLEPWLIKEMDACLSDIWLHKDIDAFAQVFHLILTENVSVDYRHSETSATALMVAAGRGFASQVEQLISMGANVHSKASNGWMALDWAKHFGQTEIVDLLESYSATLEFGNLDESSLVQTNGSDLSAEDRELLKAYHHSFDDEKVDLDLIMHLLYNICHSCDAGAVLIFLPGYDEIVGLRDRILFDDKRFADSTHRYQVFMLHSNMQTSDQKKVLKNPPAGVRKIILSTNIAETSITVNDVVFVIDSGKVKEKSFDALNFVTMLKMVWISKASAIQRKGRAGRCRPGICFRLFSRLRFQNMLEFQTPELLRMPLQELCLHTKLLAPVNCPIADFLMKAPEPPPALIVRNAVQMLKTIDAMDTWEDLTELGYHLADLPVEPHLGKMVLCAVVLKCLDPILTIACTLAYRDPFVLPTQASQKRAAMLCRKRFTAGAFSDHMALLRAFQAWQKARSDGWERAFCEKNFLSQATMEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQELEPLVGEQLLQLWERLPLGEKNTTD

SEQ ID NO: 17398 - protein, 198 aa, Homo sapiens
MLFLGSLGAWGTTSISTGSIFSLKTLRSQHGGQVGLKVSRPRAPRMGAATPTPRAPWVARWLMGSQAFTATPSARPPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEF

SEQ ID NO: 17399 - protein, 509 aa, Homo sapiens
MSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 17400 - protein, 559 aa, Homo sapiens
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 17401 - protein, 292 aa, Homo sapiens
MLRKLWQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVSVSLGFM

SEQ ID NO: 17402 - protein, 227 aa, Homo sapiens
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKVTSHYNNISILIKVL

SEQ ID NO: 17403 - protein, 261 aa, Homo sapiens
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 17404 - protein, 1231 aa, Homo sapiens
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 17405 - protein, 634 aa, Homo sapiens
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPAPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSKRESPGVGGGSGDEASAATPPSSRRVWSPPRVHKVEMGFGGGGGAN

SEQ ID NO: 17406 - protein, 634 aa, Homo sapiens; identical to SEQ ID NO: 17405

SEQ ID NO: 17407 - protein, 634 aa, Homo sapiens; identical to SEQ ID NO: 17405

SEQ ID NO: 17408 - protein, 149 aa, Homo sapiens
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLRE

SEQ ID NO: 17409 - protein, 149 aa, Homo sapiens; identical to SEQ ID NO: 17408

SEQ ID NO: 17410 - protein, 149 aa, Homo sapiens; identical to SEQ ID NO: 17408

SEQ ID NO: 17411 - protein, 634 aa, Homo sapiens; identical to SEQ ID NO: 17405

SEQ ID NO: 17412 - protein, 634 aa, Homo sapiens; identical to SEQ ID NO: 17405

SEQ ID NO: 17413 - protein, 634 aa, Homo sapiens; identical to SEQ ID NO: 17405

SEQ ID NO: 17414 - protein, 672 aa, Homo sapiens
MESRKLISATDIQYSGSLLNSLNEQRGHGLFCDVTVIVEDRKFRAHKNILSASSTYFHQLFSVAGQVVELSFIRAEIFAEILNYIYSSKIVRVRSDLLDELIKSGQLLGVKFIAELGVPLSQVKSISGTAQDGNTEPLPPDSGDKNLVIQKSKDEAQDNGATIMPIITESFSLSAEDYEMKKIIVTDSDDDDDDVIFCSEILPTKETLPSNNTVAQVQSNPGPVAISDVAPSASNNSPPLTNITPTQKLPTPVNQATLSQTQGSEKLLVSSAPTHLTPNIILLNQTPLSTPPNVSSSLPNHMPSSINLLVQNQQTPNSAILTGNKANEEEEEEIIDDDDDTISSSPDSAVSNTSLVPQADTSQNTSFDGSLIQKMQIPTLLQEPLSNSLKISDIITRNTNDPGVGSKHLMEGQKIITLDTATEIEGLSTGCKVYANIGEDTYDIVIPVKDDPDEGEARLENEIPKTSGSEMANKRMKVKHDDHYELIVDGRVYYICIVCKRSYVCLTSLRRHFNIHSWEKKYPCRYCEKVFPLAEYRTKHEIHHTGERRYQCLACGKSFINYQFMSSHIKSVHSQDPSGDSKLYRLHPCRSLQIRQYAYLSDRSSTIPAMKDDGIGYKVDTGKEPPVGTTTSTQNKPMTWEDIFIQQENDSIFKQNVTDGSTEFEFIIPESY

SEQ ID NO: 17415 - protein, 202 aa, Homo sapiens
MLTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRSK

SEQ ID NO: 17416 - protein, 570 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGKRCFRCQICSATFTSFGEYKHHMRVSRHIIRKPRIYECKTCGAMFTNSGNLIVHLRSLNHEASELANYFQSSDFLVPDYLNQEQEETLVQYDLGEHGFESNSSVQMPVISQYHSKGKEP

SEQ ID NO: 17417 - protein, 570 aa, Homo sapiens; identical to SEQ ID NO: 17416

SEQ ID NO: 17418 - protein, 467 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGHPRKSASRSSSATNCC

SEQ ID NO: 17419 - protein, 453 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEVIS

SEQ ID NO: 17420 - protein, 474 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEVPLQRQGTMIDNSQAVDEMTRNGE

SEQ ID NO: 17421 - protein, 76 aa, Homo sapiens [sequence omitted]

SEQ ID NO: 17422 - protein, 136 aa, Homo sapiens
MAQEEEDVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPRVGRRIFIVQAPSGNRSQSNNIFSNAGL

SEQ ID NO: 17423 - protein, 147 aa, Homo sapiens
  MOD_RES (1)..(1): Any amino acid
XGGSRVSNPAVMAQEEEDVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPRVGRRIFIVQAPSGNRSQSNNIFSNAGL

SEQ ID NO: 17424 - protein, 179 aa, Homo sapiens
MKGGSRVSNPAVMAQEEEDVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 17425 - protein, 495 aa, Homo sapiens
MAANWTLSWGQGGPCNSPGSDTPRSVASPETQLGNHDRNPETWHMNFRMFSCPEESDPIQALRKLTELCHLWLRPDLHTKEQILDMLVMEQFMISMPQELQVLVKVNGVQSCKDLEDLLRNNRRPKKWSIVNLLGKEYLMLNSDVEMAEAPASVRDDPRDVSSQWASSVNQMHPGTGQARREQQILPRVAALSRRQGEDFLLHKSIDVTGDPNSPRPKQTLEKDLKENREENPGLSSPEPQLPKSPNLVRAKEGKEPQKRASVENVDADTPSACVVEREALTHSGNRGDALNLSSPKRSKPDASSISQEEPQGEATPVGNRESPGQAEINPVHSPGPAGPVSHPDGQEAKALPPFACDVCNKSFKYFSQLSIHRRSHTGDRPFQCDLCRKRFLQPSDLRVHQRVHTGERPYMCDVCQKRFAHESTLQGHKRIHTGERPFKCKYCSKVFSHKGNLNVHQRTHSGEKPYKCPTCQKAFRQLGTFKRHLKTHRETTSQ

SEQ ID NO: 17426 - protein, 496 aa, Homo sapiens
MAANCTSSWSLGESCNSPGSEPPQSMPSPATQLGNHDSDPETCHVNFRMFSCPKESDPIQALRKLTELCHLWLRPDLHTKEQILDMLVMEQFMISMPQELQVLVMMNGVQSCKDLEDLLRNNRRPKKWSVVSFLGKEYLMQESDVEMAEAPASVRDDPRHVSSQRTSSVNQMCPEEGQASQELQTLPRVPALFRRQEEDFLLPETTVMKGDPKALRPKPTLEKDLEEDREENPGLTSPEPQLPNSPTGVVGAKEGKEPQKRASVENVDADTPSACVVEREASTHSGSRGDALNLRGLKRSKPDATSISQEEPQGEATPVGNRESPGQAEINPVHSPGPAGPVSHPSGQEVKELLPFACEVCGKRFKYRGKLAVHTRSHTGERLFQCNLCGKRFMQRIGLQFHQRTHTGERPYTCDICQKQFTQKSYLKCHKRSHTGEKPFECKDCKKVFTYKANLKEHQRIHSGEKPHKCSKCPRAFGRPATLRRHQKTHREATSQ

SEQ ID NO: 17427 - protein, 496 aa, Homo sapiens; identical to SEQ ID NO: 17426

SEQ ID NO: 17428 - protein, 771 aa, Homo sapiens
MEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQKGALKLHRTTLLQAKSQILFNVLDVAHQFIKDVNPDEPKEENNSTKETSKIQHKPKSVLLQRSSSEVEITTMKRAQRTKPRKSLLCEGSFDEEASAQSFQEVLSQWRTGNHDDNKKQNLHAAVKDSLEECEVQTNLKIWREPLNIELKEDILSYMEKLWLKKHRRTPQEQLFKMLPDTFPHPHETTGDAQCSQNENDEDSDGEETKVQHTALLLPVETLNIERPEPSLKIVELDDTYEEEFEEAENIVPYKVKLADADSQRSCAFHDCQKNSFPYENGIHQHHVFDKGKRDFLNLCLRNSSTYYKDNSKAETSNTDFDNIVDPDVYSSDIEKIEESTSFERNLKEKNIGLESNQKSDDSCVSLESKDTLLGRDLEKAPIEEKLSQDIKESLELSNLYKRPSFEESKTTKSSLLLQEIACRSKPITKQYQGLERFFIFDTNERLNLLPSHRLECNNSSTRITLAGQKSQRPSTANFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRDTKIQSLLSLSESSTDEEEEDFLNKQHVITLPWSKST

SEQ ID NO: 17429 - protein, 693 aa, Homo sapiens
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRKYDESYLSFGFTYFGNRDAPHAQCVLCKKILSNSSLAPSKLRRHLETKHAAYKDKDISFFKQHLDSPENNKPPTPKIVNTDNESATEASYNVSYHIALSGEAHTIGELLIKPCAKDVVMRMFDEQYSKKIDAVQLSNSTVARRIKDLAADIEEELVCRLKICDGFSLQLDESADVSGLAVLLVFVRYRFNKSIEEDLLLCESLQSNATGEEIFNCINSFMQKHEIEWEKCVDVCSDASRAVDGKIAEAVTLIKYVAPESTSSHCLLYRHALAVKIMPTSLKNVLDQAVQIINYIKARPHQSRLLKILCEEMGAQHTALLLNTEVRWLSRGKVLVRLFELRRELLVFMDSAFRLSDCLTNSSWLLRLAYLADIFTKLNEVNLSMQGKNVTVFTVFDKMSSLLRKLEFWASSVEEENFDCFPTLSDFLTEINSTVDKDICSAIVQHLRGLRATLLKYFPVTNDNNAWVRNPFTVTVKPASLVARDYESLIDLTSDSQVKQNFSELSLNDFWSSLIQEYPSIARRAVRVLLPFATMHLCETGFSYYAATKTKYRKRLDAAPHMRIRLSNITPNIKRICDKKTQKHCSH

SEQ ID NO: 17430 - protein, 693 aa, Homo sapiens; identical to SEQ ID NO: 17429

SEQ ID NO: 17431 - protein, 434 aa, Homo sapiens
MPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 17432 - protein, 89 aa, Homo sapiens
MPDRDSYANGTGSSGGGPGGGGSEEASGAGVGSGGASSDAICRDFLRNVCKRGKRCRYRHPDMSEVSNLGVSKNEFIFCHDFQNKECSR

SEQ ID NO: 17433 - protein, 45 aa, Homo sapiens
MPDRDSYANGTGSSGGGPGGGGSEEASGAGVGSGGASSDAICRDF

SEQ ID NO: 17434 - protein, 79 aa, Homo sapiens
MPDRDSYANGTGSSGGGPGGGGSEEASGAGVGSGGASSDAICRDFLRNVCKRGKRCRYRHPDMSEVSNLGVSKNEFIFC

SEQ ID NO: 17435 - protein, 772 aa, Homo sapiens
MEKSASKEEKQQPKQDSTEQGNADSEEWMSSESDPEQISLKSSDNSKSCQPRDGQLKKKEMHSKPHRQLCRSPCLDRPSFSQNHLLMMYWQSLSDLGTKVIQKGSSREIASPELSLEDEIDNSDNLRPVVIDGSNVAMSHGNKEEFSCRGIQLAVDWFLDKGHKDITVFVPAWRKEQSRPDAPITDQDILRKLEKEKILVFTPSRRVQGRRVVCYDDRFIVKLAFDSDGIIVSNDNYRDLQVEKPEWKKFIEERLLMYSFVNDKFMPPDDPLGRHGPSLENFLRKRPIVPEHKKQPCPYGKKCTYGHKCKYYHPERANQPQRSVADELRISAKLSTVKTMSEGTLAKCGTGMSSAKGEITSEVKRVAPKRQSDPSIRSVAMEPEEWLSIARKPEASSVPSLVTALSVPTIPPPKSHAVGALNTRSASSPVPGSSHFPHQKASLEHMASMQYPPILVTNSHGTPISYAEQYPKFESMGDHGYYSMLGDFSKLNINSMHNREYYMAEVDRGVYARNPNLCSDSRVSHTRNDNYSSYNNVYLAVADTHPEGNLKLHRSASQNRLQPFPHGYHEALTRVQSYGPEDSKQGPHKQSVPHLALHAQHPSTGTRSSCPADYPMPPNIHPGATPQPGRALVMTRMDSISDSRLYESNPVRQRRPPLCREQHASWDPLPCTTDSYGYHSYPLSNSLMQPCYEPVMVRSVPEKMEQLWRNPWVGMCNDSREHMIPEHQYQTYKNLCNIFPSNIVLAVMEKNPHTADAQQLAALIVAKLRAAR

SEQ ID NO: 17436 - protein, 836 aa, Homo sapiens
MTATAEVETPKMEKSASKEEKQQPKQDSTEQGNADSEEWMSSESDPEQISLKSSDNSKSCQPRDGQLKKKEMHSKPHRQLCRSPCLDRPSFSQSSILQDGKLDLEKEYQAKMEFALKLGYAEEQIQSVLNKLGPESLINDVLAELVRLGNKGDSEGQINLSLLVPRGPSSREIASPELSLEDEIDNSDNLRPVVIDGSNVAMSHGNKEEFSCRGIQLAVDWFLDKGHKDITVFVPAWRKEQSRPDAPITDQDILRKLEKEKILVFTPSRRVQGRRVVCYDDRFIVKLAFDSDGIIVSNDNYRDLQVEKPEWKKFIEERLLMYSFVNDKFMPPDDPLGRHGPSLENFLRKRPIVPEHKKQPCPYGKKCTYGHKCKYYHPERANQPQRSVADELRISAKLSTVKTMSEGTLAKCGTGMSSAKGEITSEVKRVAPKRQSDPSIRSVAMEPEEWLSIARKPEASSVPSLVTALSVPTIPPPKSHAVGALNTRSASSPVPGSSHFPHQKASLEHMASMQYPPILVTNSHGTPISYAEQYPKFESMGDHGYYSMLGDFSKLNINSMHNREYYMAEVDRGVYARNPNLCSDSRVSHTRNDNYSSYNNVYLAVADTHPEGNLKLHRSASQNRLQPFPHGYHEALTRVQSYGPEDSKQGPHKQSVPHLALHAQHPSTGTRSSCPADYPMPPNIHPGATPQPGRALVMTRMDSISDSRLYESNPVRQRRPPLCREQHASWDPLPCTTDSYGYHSYPLSNSLMQPCYEPVMVRSVPEKMEQLWRNPWVGMCNDSREHMIPEHQYQTYKNLCNIFPSNIVLAVMEKNPHTADAQQLAALIVAKLRAAR

SEQ ID NO: 17437 - protein, 825 aa, Homo sapiens
MEKSASKEEKQQPKQDSTEQGNADSEEWMSSESDPEQISLKSSDNSKSCQPRDGQLKKKEMHSKPHRQLCRSPCLDRPSFSQSSILQDGKLDLEKEYQAKMEFALKLGYAEEQIQSVLNKLGPESLINDVLAELVRLGNKGDSEGQINLSLLVPRGPSSREIASPELSLEDEIDNSDNLRPVVIDGSNVAMSHGNKEEFSCRGIQLAVDWFLDKGHKDITVFVPAWRKEQSRPDAPITDQDILRKLEKEKILVFTPSRRVQGRRVVCYDDRFIVKLAFDSDGIIVSNDNYRDLQVEKPEWKKFIEERLLMYSFVNDKFMPPDDPLGRHGPSLENFLRKRPIVPEHKKQPCPYGKKCTYGHKCKYYHPERANQPQRSVADELRISAKLSTVKTMSEGTLAKCGTGMSSAKGEITSEVKRVAPKRQSDPSIRSVAMEPEEWLSIARKPEASSVPSLVTALSVPTIPPPKSHAVGALNTRSASSPVPGSSHFPHQKASLEHMASMQYPPILVTNSHGTPISYAEQYPKFESMGDHGYYSMLGDFSKLNINSMHNREYYMAEVDRGVYARNPNLCSDSRVSHTRNDNYSSYNNVYLAVADTHPEGNLKLHRSASQNRLQPFPHGYHEALTRVQSYGPEDSKQGPHKQSVPHLALHAQHPSTGTRSSCPADYPMPPNIHPGATPQPGRALVMTRMDSISDSRLYESNPVRQRRPPLCREQHASWDPLPCTTDSYGYHSYPLSNSLMQPCYEPVMVRSVPEKMEQLWRNPWVGMCNDSREHMIPEHQYQTYKNLCNIFPSNIVLAVMEKNPHTADAQQLAALIVAKLRAAR

SEQ ID NO: 17438 - protein, 883 aa, Homo sapiens
MPGGGSQEYGVLCIQEYRKNSKVESSTRNNFMGLKDHLGHDLGHLYVESTDPQLSPAVPWSTVENPSMDTVNVGKDEKEASEENASSGDSEENTNSDHESEQLGSISVEPGLITKTHRQLCRSPCLEPHILKRNEILQDFKPEESQTTSKEAKKPPDVVREYQTKLEFALKLGYSEEQVQLVLNKLGTDALINDILGELVKLGNKSEADQTVSTINTITRETSSLESQRSESPMQEIVTDDGENLRPIVIDGSNVAMSHGNKEVFSCRGIKLAVDWFLERGHKDITVFVPAWRKEQSRPDALITDQEILRKLEKEKILVFTPSRRVQGRRVVCYDDRFIVKLAFESDGIIVSNDNYRDLANEKPEWKKFIDERLLMYSFVNDKFMPPDDPLGRHGPSLDNFLRKKPIVPEHKKQPCPYGKKCTYGHKCKYYHPERGSQPQRSVADELRAMSRNTAAKTANEGGLVKSNSVPCSTKADSTSDVKRGAPKRQSDPSIRTQVYQDLEEKLPTKNKLETRSVPSLVSIPATSTAKPQSTTSLSNGLPSGVHFPPQDQRPQGQYPSMMMATKNHGTPMPYEQYPKCDSPVDIGYYSMLNAYSNLSLSGPRSPERRFSLDTDYRISSVASDCSSEGSMSCGSSDSYVGYNDRSYVSSPDPQLEENLKCQHMHPHSRLNPQPFLQNFHDPLTRGQSYSHEEPKFHHKPPLPHLALHLPHSAVGARSSCPGDYPSPPSSAHSKAPHLGRSLVATRIDSISDSRLYDSSPSRQRKPYSRQEGLGSWERPGYGIDAYGYRQTYSLPDNSTQPCYEQFTFQSLPEQQEPAWRIPYCGMPQDPPRYQDNREKIYINLCNIFPPDLVRIVMKRNPHMTDAQQLAAAILVEKSQLGY

SEQ ID NO: 17439 - protein, 1668 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEETNKSERTESLEGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 17440 - protein, 1564 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEETNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKGSFILL

SEQ ID NO: 17441 - protein, 624 aa, Homo sapiens [sequence omitted]

SEQ ID NO: 17442 - protein, 115 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRVG

SEQ ID NO: 17443 - protein, 484 aa, Homo sapiens
MEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRKEKK

SEQ ID NO: 17444 - protein, 1303 aa, Homo sapiens
MEAAPGTPPPPPSESPPPPSPPPPSTPSPPPCSPDARPATPHLLHHRLPLPDDREDGELEEGELEDDGAEETQDTSGGPERSRKEKGEKHHSDSDEEKSHRRLKRKRKKEREKEKRRSKKRRKSKHKRHASSSDDFSDFSDDSDFSPSEKGHRKYREYSPPYAPSHQQYPPSHATPLPKKAYSKMDSKSYGMYEDYENEQYGEYEGDEEEDMGKEDYDDFTKELNQYRRAKEGSSRGRGSRGRGRGYRGRGSRGGSRGRGMGRGSRGRGRGSMGGDHPEDEEDFYEEEMDYGESEEPMGDDDYDEYSKELNQYRRSKDSRGRGLSRGRGRGSRGRGKGMGRGRGRGGSRGGMNKGGMNDDEDFYDEDMGDGGGGSYRSRDHDKPHQQSDKKGKVICKYFVEGRCTWGDHCNFSHDIELPKKRELCKFYITGFCARAENCPYMHGDFPCKLYHTTGNCINGDDCMFSHDPLTEETRELLDKMLADDAEAGAEDEKEVEELKKQGINPLPKPPPGVGLLPTPPRPPGPQAPTSPNGRPMQGGPPPPPPPPPPPPGPPQMPMPVHEPLSPQQLQQQDMYNKKIPSLFEIVVRPTGQLAEKLGVRFPGPGGPPGPMGPGPNMGPPGPMGGPMHPDMHPDMHPDMHPDMHADMHADMPMGPGMNPGPPMGPGGPPMMPYGPGDSPHSGMMPPIPPAQNFYENFYQQQEGMEMEPGLLGDAEDYGHYEELPGEPGEHLFPEHPLEPDSFSEGGPPGRPKPGAGVPDFLPSAQRALYLRIQQKQQEEEERARRLAESSKQDRENEEGDTGNWYSSDEDEGGSSVTSILKTLRQQTSSRPPASVGELSSSGLGDPRLQKGHPTGSRLADPRLSRDPRLTRHVEASGGSGPGDSGPSDPRLARALPTSKPEGSLHSSPVGPSSSKGSGPPPTEEEEGERALREKAVNIPLDPLPGHPLRDPRSQLQQFSHIKKDVTLSKPSFARTVLWNPEDLIPLPIPKQDAVPPVPAALQSMPTLDPRLHRAATAGPPNARQRPGASTDSSTQGANLPDFELLSRILKTVNATGSSAAPGSSDKPSDPRVRKAPTDPRLQKPTDSTASSRAAKPGPAEAPSPTASPSGDASPPATAPYDPRVLAAGGLGQGGGGGQSSVLSGISLYDPRTPNAGGKATEPAADTGAQPKGAEGNGKSSASKAKEPPFVRKSALEQPETGKAGADGGTPTDRYNSYNRPRPKAAAAPAATTATPPPEGAPPQPGVHNLPVPTLFGTVKQTPKTGSGSPFAGNSPAREGEQDAASLKDVFKGFDPTASPFCQ

SEQ ID NO: 17445 - protein, 1189 aa, Homo sapiens
MTDSEHAGHDREDGELEDGEIDDAGFEEIQEKEAKENEKQKSEKAYRKSRKKHKKEREKKKSKRRKREKHKHNSPSSDDSSDYSLDSDVEHTESSHKKRTGFYRDYDIPFTQRGHISGSYITSKKGQHNKKFKSKEYDEYSTYSDDNFGNYSDDNFGNYGQETEEDFANQLKQYRQAKETSNIALGSSFSKESGKKQRMKGVQQGIEQRVKSFNVGRGRGLPKKIKRKERGGRTNKGPNVFSVSDDFQEYNKPGKKWKVMTQEFINQHTVEHKGKQICKYFLEGRCIKGDQCKFDHDAELEKRKEICKFYLQGYCTKGENCIYMHNEFPCKFYHSGAKCYQGDNCKFSHDDLTKETKKLLDKVLNTDEELINEDERELEELRKRGITPLPKPPPGVGLLPTPPEHFPFSDPEDDFQTDFSDDFRKIPSLFEIVVKPTVDLAHKIGRKPPAFYTSASPPGPQFQGSSPHPQHIYSSGSSPGPGPNMSQGHSSPVMHPGSPGHHPCAGPPGLPVPQSPPLPPGPPEIVGPQNQAGVLVQPDTSLTPPSMGGAYHSPGFPGHVMKVPRENHCSPGSSYQQSPGEMQLNTNYESLQNPAEFYDNYYAQHSIHNFQPPNNSGDGMWHGEFAQQQPPVVQDSPNHGSGSDGSSTRTGHGPLPVPGLLPAVQRALFVRLTQRYQEDEEQTSTQPHRAPSKEEDDTVNWYSSSEEEEGSSVKSILKTLQKQTETLRNQQQPSTELSTPTDPRLAKEKSKGNQVVDPRLRTIPRQDIRKPSESAPLDLRLAWDPRKLRGNGSGHIGSSVGGAKFDLHHANAGTNVKHKRGDDDDEDTERELREKAFLIPLDASPGIMLQDPRSQLRQFSHIKMDITLTKPNFAKHIVWAPEDLLPVPLPKPDPVSSINLPLPPLIADQRLNRLWNTKSDLHQNTVSIDPKLAAKAKINTTNREGYLEQFGDSHGSGAKLGDPRLQKNFDPRLHRLPNTESHQVVMKDSHASKGAPHLPRSNPGSSQPSGAGTSNSGSGALPPYAPKLSSSAGLPLGTSTSVLSGISLYDPRDHGSSSTSELATASSGENSKNQKKSGGLKSSDKTEPSPGEAILPQKPSPNVGVTLEGPADPQADVPRSSGKVQVPAVHSLPVQALTGLIRPQYSDPRQARQPGQGSPTPDNDPGRETDDKSLKEVFKTFDPTASPFC

SEQ ID NO: 17446 - protein, 1189 aa, Homo sapiens; identical to SEQ ID NO: 17445

SEQ ID NO: 17447 - protein, 892 aa, Homo sapiens
MQDLKKYKKKKQKRMKSRKVRKPTENQEKNIRKRERKKSKRRKREKHKHNSPSSDDSSDYSLDSDVEHTESSHKKRTGFYRDYDIPFTQRGHISGSYITSKKGQHNKKFKSKEYDEYSTYSDDNFGNYSDDNFGNYGQETEEDFANQLKQYRQAKETSNIALGSSFSKESGKKQRMKGVQQGIEQRVKSFNVGRGRGLPKKIKRKERGGRTNKGPNVFSVSDDFQEYNKPGKKWKVMTQEFINQHTVEHKGKQICKYFLEGRCIKGDQCKFDHDAELEKRKEICKFYLQGYCTKGENCIYMHNEFPCKFYHSGAKCYQGDNCKFSHDDLTKETKKLLDKVLNTDEELINEDERELEELRKRGITPLPKPPPGVGLLPTPPEHFPFSDPEDDFQTDFSDDFRKIPSLFEIVVKPTVDLAHKIGRKPPAFYTSASPPGPQFQGSSPHPQHIYSSGSSPGPGPNMSQGHSSPVMHPGSPGHHPCAGPPGLPVPQSPPLPPGPPEIVGPQNQAGVLVQPDTSLTPPSMGGAYHSPGFPGHVMKVPRENHCSPGSSYQQSPGEMQLNTNYESLQNPAEFYDNYYAQHSIHNFQPPNNSGDGMWHGEFAQQQPPVVQDSPNHGSGSDGSSTRTGHGPLPVPGLLPAVQRALFVRLTQRYQEDEEQTSTQPHRAPSKEEDDTVNWYSSSEEEEGSSVKSILKTLQKQTETLRNQQQPSTELSTPTDPRLAKEKSKGNQVVDPRLRTIPRQDIRKPSESAPLDLRLAWDPRKLRGNGSGHIGSSVGGAKFDLHHANAGTNVKHKRGDDDDEDTERELREKAFLIPLDASPGIMLQDPRSQLRQFSHIKMDITLTKPNFAKHIVWAPEDLLPVPLPKPDPVSSINLPLPPLIADQRLNRLW

SEQ ID NO: 17448 - protein, 300 aa, Homo sapiens
MAEPTVCSFLTKVLCAHGGRMFLKDLRGHVELSEARLRDVLQRAGPERFLLQEVETQEGLGDAEAEAAAGAVGGGGTSAWRVVAVSSVRLCARYQRGECQACDQLHFCRRHMLGKCPNRDCWSTCTLSHDIHTPVNMQVLKSHGLFGLNENQLRILLLQNDPCLLPEVCLLYNKGEALYGYCNLKDKCNKFHVCKSFVKGECKLQTCKRSHQLIHAASLKLLQDQGLNIPSVVNFQIISTYKHMKLHKMLENTDNSSPSTEHSQGLEKQGVHAAGAAEAGPLASVPAQSAKKPCPVSCEK

SEQ ID NO: 17449 - protein, 102 aa, Homo sapiens
MAEPTVCSFLTKVLCAHGGRMFLKDLRGHVELSEARLRDVLQRAGPERFLLQEVETQEGLGDAEAEAAAGAVGGGGTSAWRVVAVSGTIGACHHTQLIFLGF

SEQ ID NO: 17450 - protein, 524 aa, Homo sapiens
MMTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTALRKNLKLPRARPWQPAFQREKKLEQCQRTWAYQRVRGPAPHLRKKSPDTGNP

SEQ ID NO: 17451 - protein, 109 aa, Homo sapiens
PMVGLLVHTAATFNYSFRKIRGLLCPQHKQRGVQANQTPVLFLHISCVYYSLYLFFLFCCLFLIPLEQKMTTSPLPYPCDNIHVTVWPLGEVLMETRMWESKIGLEMRL

SEQ ID NO: 17452 - protein, 132 aa, Homo sapiens
MRNMIPQDNENPPQQGEANQNDFALVAQAGVQWLDLGPQLPLLPGFKQFFCLSLLSSCGYSWSLALSPRLECSGAISAYGKLRLPGSCHSPASASRVARTTGARHHTRLIFVFLVETRFHRVSQDGLDLLTS

SEQ ID NO: 17453 - protein, 296 aa, Homo sapiens
MIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 17454 - protein, 527 aa, Homo sapiens
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGFLAQDSVPAEKRNTEMLDNLPSAGSQFPDFKHLGTFLVFEELVTFEDVLVDFSPEELSSLSAAQRNLYREVMLENYRNLVSLGHQFSKPDIISRLEEEESYAMETDSRHTVICQGESHDDPLEPHQGNQEKLLTPITMNDPKTLTPERSYGSDEFERSSNLSKQSKDPLGKDPQEGTAPGICTSPQSASQENKHNRCEFCKRTFSTQVALRRHERIHTGKKPYECKQCAEAFYLMPHLNRHQKTHSGRKTSGCNEGRKPSVQCANLCERVRIHSQEDYFECFQCGKAFLQNVHLLQHLKAHEAARVLPPGLSHSKTYLIRYQRKHDYVGERACQCCDCGRVFSRNSYLIQHYRTHTQERPYQCQLCGKCFGRPSYLTQHYQLHSQEKTVECDHC

SEQ ID NO: 17455 - protein, 602 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 17456 - protein, 639 aa, Homo sapiens
MTPASASGEDSGSFYSWQKAKREQGLVTFEDVAVDFTQEEWQYLNPPQRTLYRDVMLETYSNLVFVGQQVTKPNLILKLEVEECPAEGKIPFWNFPEVCQVDEQIERQHQDDQDKCLLMQVGFSDKKTIITKSARDCHEFGNILHLSTNLVASIQRPDKHESFGNNMVDNLDLFSRSSAENKYDNGCAKLFFHTEYEKTNPGMKPYGYKECGKGLRRKKGLSLHQRIKNGEKPFECTACRKTFSKKSHLIVHWRTHTGEKPFGCTECGKAFSQKSQLIIHLRTHTGERPFECPECGKAFREKSTVIIHYRTHTGEKPYECNECGKAFTQKSNLIVHQKTHTGEKTYECTKCGESFIQKLDLIIHHSTHTGKKPHECNECKKTFSDKSTLIIHQRTHTGEKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKAFREKSKLIIHQRIHTGEKPYECPVCWKAFSQKSQLIIHQRTHTGEKPYACTECGKAFREKSTFTVHQRTHTGEKPYKCTECGKAFTQKSNLIVHQRTHAGKKAHGRGHTRKSKFMAH

SEQ ID NO: 17457 - protein, 330 aa, Homo sapiens
  MOD_RES (1)..(1): Any amino acid
XSEMAARDELGLGGDSLEAMPVPAARGRPRITNGPEELAAPSPAALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 17458 - protein, 388 aa, Homo sapiens
MAAVSPTTRCQESVTFEDVAVVFTDEEWSRLVPIQRDLYKEVMLENYNSIVSLDWETKPEIHDASDKKSEGSLRECLGRQSPLCPKFEVHTPNGRMGTEKQSPSGETRKKSLSRDKGLRRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 17459 - protein, 682 aa, Homo sapiens
MIPKQDISEELESQRAKSEDHVRNIFKETEEMSKTEGKLENCWRKYAVEGVKNSFSQKSNFREITMRYVKTLSRENGQKFNAVGENCITDSNPAKHLRGSREESLHPSVSSVENLQQHEDLINLQSFQLGERAYQTDVLVKVPRQSSVLSENQRMNNPERWFESTGCGKTYNQNRAFNQHQRFHSGEKTYEHNECGKAFSWPSILSKHQRIHTGKKLYTCEDCGKSFSVHSYFIQHCKIHTREKPYECIKCGKAFSTHSSYVQHLKIHTGEKHHECNQCGKAFSHSSNLIHHQRIHSGEKPYKCKECGKAFNRQSNLIQHQRIHSGEKPYDCKECGKAFSTQLFLIQHQRIHTGEKPYECNECAKSFSLNRTLTVHQRIHTGEKPYRCNECGKSFSQCSQVIQHKRIHTGEKPYICNECGKSFGARLSLIQHQRIHTGEKPYGCREKPYECSECGKAFSQSFNLIHHQRTHNGEKSYECNECDKAFSLLSSLVQHQRIHNGDKPYECHKCGKAFSQGSHLIQHQRSHIGEKPYECNECGKTFGQISTLIKHERTHNGEKPYECSDCGKAFSQSAHLIHHQRIHTGENPYECSECGKAFNVCSSLIQHHRIHTGEKPYECSDCGKAFSQHSQFIQHQRIHTGEKPYMCNECEKSFSACLSLIQHKRIHTGEKPYVCAKCGKSF

SEQ ID NO: 17460 - protein, 472 aa, Homo sapiens
MMGTYGNLLSLGCDSRIEKEEMIPKQDISEELESQRAKSEDHVRNIFKETEEMSKTEGKLENCWRKYAVEGVKNSFSQKSNFREITMRYVKTLSRENGQKFNAVGENCITDSNPAKHLRGSREESLHPSVSSVENLQQHEDLINLQSFQLGERAYQTDVLVKVPRQSSVLSENQRMNNPERWFESTGCGKTYNQNRAFNQHQRFHSGEKTYEHNECGKAFSWPSILSKHQRIHTGKKLYTCEDCGKSFSVHSYFIQHCKIHTREKPYECIKCGKAFSTHSSYVQHLKIHTGEKHHECNQCGKAFSHSSNLIHHQRIHSGEKPYKCKECGKTFGQISTLIKHERTHNGEKPYECSDCGKAFSQSAHLIHHQRIHTGENPYECSECGKAFNVCSSLIQHHRIHTGEKPYECSDCGKAFSQHSQFIQHQRIHTGEKPYMCNECEKSFSACLSLIQHKRIHTGEKPYVCAKCGKSF

SEQ ID NO: 17461 - protein, 399 aa, Homo sapiens
MSQVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 17462 - protein, 443 aa, Homo sapiens
MSQRQYPECYLAPNGCLVSNCGVNKMSNEELVGQNHGMEGEACTGGDVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 17463 - protein, 399 aa, Homo sapiens; identical to SEQ ID NO: 17461

SEQ ID NO: 17464 - protein, 142 aa, Homo sapiens
MSQVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSA

SEQ ID NO: 17465 - protein, 399 aa, Homo sapiens; identical to SEQ ID NO: 17461

SEQ ID NO: 17466 - protein, 132 aa, Homo sapiens
MSQVTFSDVAIDFSHEEWACLDSAQRDLYKDVMVQNYENLVSVAGLSVTKPYVIMLLEDGKEPWMMEKKLSKAYPFPLSHSVPASVNFGFSALFEHCSEVTEIFELSELCVFWVLHFLSNSPNSTVEAFFKK

SEQ ID NO: 17467 - protein, 132 aa, Homo sapiens; identical to SEQ ID NO: 17466

SEQ ID NO: 17468 - protein, 666 aa, Homo sapiens
MQEVVLLDESSGPPSQLLWTRQDTQLPQESALLPAPYPAFTKDGSQGNLPQADITLMSQAQESVTFEDVAVNFTNREWQCLTYAQRHLYKDVMLENYGNMVSLGFPFPKPPLISHLEREVDPCVQDPQDRESLSCSYPVSADKMWPENEKASSQQEIFENGEAYWMKFNSLLKVDSRDPKVREVCVQDVKLENQWETSIREKLREEKEGSEEVTCKKGKNQKVLSKNLNPNSKHSQCNKVLIAQKLHECARCGKNFSWHSDLILHEQIHSGEKPHVCNECGKAFKTRNQLSMHRIIHTGEKPFNCTQCGKAFNSRSALCRHKKTHSGEKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDQHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 17469 - protein, 574 aa, Homo sapiens
MLENYGNMVSLGFPFPKPPLISHLEREVDPCVQDPQDRESLSCSYPVSADKMWPENEKASSQQEIFENGEAYWMKFNSLLKVDSRDPKVREVCVQDVKLENQWETSIREKLREEKEGSEEVTCKKGKNQKVLSKNLNPNSKHSQCNKVLIAQKLHECARCGKNFSWHSDLILHEQIHSGEKPHVCNECGKAFKTRNQLSMHRIIHTGEKPFNCTQCGKAFNSRSALCRHKKTHSGEKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDQHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 17470 - protein, 233 aa, Homo sapiens
MLREEATKKSKEKEPGMALPQGRLTFRDVAIEFSLEEWKCLNPAQRALYRAVMLENYRNLEFVDISSKCMMKEFSSTAQGNTEVIHTGTLQRHESHHIRDFCFQEIEKDIHNFEFQWQEEERNGHEAPMTEIKELTGSTDRHDQRHAGNKPIKDQLGSSFHSHLPELHIFQPEWKIGNQVEKSIINASLILTSQRISCSPKTRISNNYGNNSLHSSLPIQKLGSTHERKIFPM

SEQ ID NO: 17471 - protein, 402 aa, Homo sapiens
MYTSEEKCNQRTQKRKIYNVCPRKGKKIFIHMHEIIQIDGHIYQCLECKQNFCENLALIMCERTHTGEKPYKCDMCEKTFVQSSDLTSHQRIHNYEKPYKCSKCEKSFWHHLALSGHQRTHAGKKFYTCDICGKNFGQSSDLLVHQRSHTGEKPYLCSECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKPFVCNVSEKGLELSPPHASEASQMS

SEQ ID NO: 17472 - protein, 247 aa, Homo sapiens
MVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTGEKPYQCSQCSKLFSKRTLLKKHQKIHTGERP

SEQ ID NO: 17473 - protein, 550 aa, Homo sapiens
QVPLTFSDVAIDFSQEEWEYLNSDQRDLYRDVMLENYTNLVSLDFNFTTESNKLSSEKRNYEVNAYHQETWKRNKTFNLMRFIFRTDPQYTIEFGRQQRPKVGCFSQMIFKKHKSLPLHKRNNTREKSYECKEYKKGFRKYLHLTEHLRDHTGVIPYECNECGKAFVVFQHFIRHRKIHTDLKPYECNGCEKAFRFYSQLIQHQIIHTGMKPYECKQCGKAFRRHSHLTEHQKIHVGLKPFECKECGETFRLYRHMCLHQKIHHGVKPYKCKECGKAFGHRSSLYQHKKIHSGEKPYKCEQCEKAFVRSYLLVEHQRSHTGEKPHECMECGKAFGKGSSLLKHKRIHSSEKLYDCKDCGKAFCRGSQLTQHQRIHTGEKPHECKECGKTFKLHSYLIQHQIIHTDLKPYECKQCGKAFSRVGDLKTHQSIHAGEKPYECKECGKTFRLNSQLIYHQTIHTGLKPYVCKECKKAFRSISGLSQHKRIHTGEKPYECKECDKAFNRSDRLTQHETIHTGVKPQKCKECGKAFSHCYQLSQHQRFHHGERLLM

SEQ ID NO: 17474 - protein, 555 aa, Homo sapiens
MAFTQLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 17475 - protein, 567 aa, Homo sapiens
MPELYTEDFIQGCDVGELQEPGLPGLECNGAISAHCNLRLPDSNDSPASASRVAGITDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 17476 - protein, 542 aa, Homo sapiens
MWEHRKEPWTIESQVRVARKPKGWEWIKGVKTDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 17477 - protein, 603 aa, Homo sapiens
MPELYTEDFIQGCDVGELQEPGLPGVLSYVGAQERALDHRKPSTSSKKTKRVGMDQRCENRLECNGAISAHCNLRLPDSNDSPASASRVAGITDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 17478 - protein, 603 aa, Homo sapiens; identical to SEQ ID NO: 17477

SEQ ID NO: 17479 - protein, 555 aa, Homo sapiens
MDGDGLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 17480 - protein, 188 aa, Homo sapiens
MTETREPAETGGYASLEEDDEDLSPGPEHSSDSEYTLSEPDSEEEEDEEEEEEETTDDPEYDPGYKVKQRLGGGRGGPSRRAPRAAQPPAQPCQLCGRSPLGEAPPGTPPCRLCCPATAPQEAPAPEGRALGEEEEEPPRAGEGRPAGREEEEEEEEEGTYHCTECEDSFDNLGELHGHFMLHARGEV

SEQ ID NO: 17481 - protein, 124 aa, Homo sapiens
MTETREPAETGGYASLEEDDEDLSPGPEHSSDSEYTLSEPDSEEEEDEEEEEEETTDDPEYDPGYKVKQRLGGGRGGPSRRAPRAAQPPAQPCQLCGRSPLGEAPPGTPPYGELGRRGGVGGGG

SEQ ID NO: 17482 - protein, 803 aa, Homo sapiens
MDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 17483 - protein, 364 aa, Homo sapiens
MERGKKKRISNKLQQTFHHSKEPTFLINQAGLLSSDSYSSLSPETESVNPGENIKTDTQKKRPGTVILSKLSSRRIISESQLSPPVIPARRPGFRVCYICGREFGSQSIAIHEPQCLQKWHIENSKLPKHLRRPEPSKPQSLSSSGSYSLQATNEAAFQSAQAQLLPCESCGRTFLPDHLLVHHRSCKPKGEGPRAPHSNSSDHLTGLKKACSGTPARPRTVICYICGKEFGTLSLPIHEPKCLEKWKMENDRLPVELHQPLPQKPQPLPNAQSSQAGPNQAQLVFCPHCSRIFTSDRLLVHQRSCKTHPYGPKYQNLNLGSKGGLKEYTNSKQQRNRAAPSVTDKVIHATQDALGEPGGALCL

SEQ ID NO: 17484 - protein, 63 aa, Homo sapiens
MERGKKKRISNKLQQTFHHSKEPTFLINQAGLLSSDSYSSLSPETESVNPGENIKTDTQKKRP

SEQ ID NO: 17485 - protein, 36 aa, Homo sapiens
MERGKKKRISNKLQQTFHHSKEPTFLINQAGLLSSD

SEQ ID NO: 17486 - protein, 1483 aa, Homo sapiens
MPSEQKQLFCDEKQTTLKKDYDVKNEIVDRSAPKPKISGSIHYALKNVKIDLPKINIPNEVLLKHEVDKYRKLFQSKQQTARKSISIKTVSCVEECTLLHKSERAEEEGVKMSAKILNFSCLKCRDNTRYSPNDLQKHFQMWHHGELPSYPCEMCNFSANDFQVFKQHRRTHRSTLVKCDICNNESVYTLLNLTKHFTSTHCVNGNFQCEKCKFSTQDVGTFVQHIHRHNEIHYKCGKCHHVCFTKGELQKHLHIHSGTFPFTCQYCSYGATRREHLVRHVITLHKEHLYAKEKLEKDKYEKRMAKTSAGLKLILKRYKIGASRKTFWKRKKINSGSDRSIEKNTQVLKKMNKTQTKSEDQSHVVQEHLSEEKDERLHCENNDKAPESESEKPTPLSTGQGNRAEEGPNASSGFMKTAVLGPTLKNVMMKNNKLAVSPNYNATFMGFKMMDGKQHIVLKLVPIKQNVCSPGSQSGAAKDGTANLQPQTLDTNGFLTGVTTELNDTVYMKAATPFSCSSSILSGKASSEKEMTLISQRNNMLQTMDYEKSVSSLSATSELVTASVNLTTKFETRDNVDFWGNHLTQSHPEVLGTTIKSPDKVNCVAKPNAYNSGDMHNYCINYGNCELPVESSNQGSLPFHNYSKVNNSNKRRRFSGTAVYENPQRESSSSKTVVQQPISESFLSLVRQESSKPDSLLASISLLNDKDGTLKAKSEIEEQYVLEKGQNIDGQNLYSNENQNLECATEKSKWEDFSNVDSPMMPRITSVFSLQSQQASEFLPPEVNQLLQDVLKIKPDVKQDSSNTPNKGLPLHCDQSFQKHEREGKIVESSKDFKVQGIFPVPPGSVGINVPTNDLNLKFGKEKQVSSIPQDVRDSEKMPRISGFGTLLKTQSDAIITQQLVKDKLRATTQNLGSFYMQSPLLNSEQKKTIIVQTSKGFLIPLNITNKPGLPVIPGNALPLVNSQGIPASLFVNKKPGMVLTLNNGKLEGVSAVKTEGAPARGTVTKEPCKTPILKVEPNNNCLTPGLCSSIGSCLSMKSSSENTLPLKGPYILKPTSSVKAVLIPNMLSEQQSTKLNISDSVKQQNEIFPKPPLYTFLPDGKQAVFLKCVMPNKTELLKPKLVQNSTYQNIQPKKPEGTPQRILLKIFNPVLNVTAANNLSVSNSASSLQKDNVPSNQIIGGEQKEPESRDALPFLLDDLMPANEIVITSTATCPESSEEPICVSDCSESRVLRCKTNCRIERNFNRKKTSKKIFSKTKTHGSKDSETAFVSRNRNCKRKCRDSYQEPPRRKATLHRKCKEKAKPEDVRETFGFSRPRLSKDSIRTLRLFPFSSKQLVKCPRRNQPVVVLNHPDADAPEVVSVMKTIAKFNGHVLKVSLSKRTINALLKPVCYNPPKTTYDDFSKRHKTFKPVSSVKERFVLKLTLKKTSKNNYQIVKTTSENILKAKFNCWFCGRVFDNQDTWAGHGQRHLMEATRDWNMLE

SEQ ID NO: 17487 - protein, 577 aa, Homo sapiens
MAVGLCKAMSQGLVTFRDVALDFSQEEWEWLKPSQKDLYRDVMLENYRNLVWLDWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 17488 - protein, 609 aa, Homo sapiens
MAVGLCKAMSQGLVTFRDVALDFSQEEWEWLKPSQKDLYRDVMLENYRNLVWLGLSISKPNMISLLEQGKEPWMVERKMSQGHCADWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 17489 - protein, 557 aa, Homo sapiens
TGLSISKPNMISLLEQGKEPWMVERKMSQGHCADWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 17490 - protein, 563 aa, Homo sapiens
MANSSFIGDHVHGAPHAVMPEVEFPDQFFTVLTMDHELVTLRDVVINFSQEEWEYLDSAQRNLYWDVMMENYSNLLSLDLESRNETKHLSVGKDIIQNTGSQWEVMESSKLCGLEGSIFRNDWQSKSKIDLQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYKCKEYRRTFERVGKVTPLQRVHDGEKHFECSFCGKSFRVHAQLTRHQKIHTDEKTYKCMECGKDFRFHSQLTEHQRIHTGEKPYKCMHCEKVFRISSQLIEHQRIHTGEKPYACKECGKAFGVCRELARHQRIHTGKKPYECKACGKVFRNSSSLTRHQRIHTGEKPYKCKECEKAFGVGSELTRHERIHSGQKPYECKECGKFFRLTSALIQHQRIHSGEKPYECKVCGKAFRHSSALTEHQRIHTGEKPYECKACGKAFRHSSSFTKHQRIHTDDKPYECKECGNSFSVVGHLTCQPKIYTGEKSFD

SEQ ID NO: 17491 - protein, 563 aa, Homo sapiens; identical to SEQ ID NO: 17490

SEQ ID NO: 17492 - protein, 402 aa, Homo sapiens
MAAVILPSTAAPSSLFPASQQKGHTQGGELVNELLTSWLRGLVTFEDVAVEFTQEEWALLDPAQRTLYRDVMLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTSNSYLSVHKRIHNRWI

SEQ ID NO: 17493 - protein, 365 aa, Homo sapiens
MREKSFQCNETGEAFNCSSFVRKHQIIHLGEKQYKFDICGKVFNEKRYLARHRRCHTSEKPYKCNECGKSFSYKSSLTCHRRCHTGEKPYKCNECGKSFSYKSSLTCHHRCHTGEKPYKCNECGKSFSYKSSLRCHRRLHTGIKPYKCNECGKMFGQNSTLVIHKAIHTGEKPYKCNECGKAFNQQSHLSRHHRLHTGEKPYKCNDCGKAFIHQSSLARHHRLHTGEKSYKCEECDRVFSQKSNLERHKIIHTGEKPYKCNECHKTFSHRSSLPCHRRLHSGEKPYKCNECGKTFNVQSHLSRHHRLHTGEKPYKCKVCDKAFMCHSYLANHTRIHSGEKPYKCNECGKAHNHLIDSSIKPCMSS

SEQ ID NO: 17494 - protein, 590 aa, Homo sapiens
MLHEEAAQKRKGKEPGMALPQGRLTFRDVAIEFSLAEWKFLNPAQRALYREVMLENYRNLEAVDISSKRMMKEVLSTGQGNTEVIHTGMLQRHESYHTGDFCFQEIEKDIHDFEFQSQKDERNGHEASMPKIKELMGSTDRHDQRHAGNKPIKDQLGLSFHLHLPELHIFQPEEKIANQVEKSVNDASSISTSQRISCRPETHTPNNYGNNFFHSSLLTQKQEVHMREKSFQCNETGEAFNCSSFVRKHQIIHLGEKQYKFDICGKVFNEKRYLARHRRCHTSEKPYKCNECGKSFSYKSSLTCHRRCHTGEKPYKCNECGKSFSYKSSLTCHHRCHTGEKPYKCNECGKSFSYKSSLRCHRRLHTGIKPYKCNECGKMFGQNSTLVIHKAIHTGEKPYKCNECGKAFNQQSHLSRHHRLHTGEKPYKCNDCGKAFIHQSSLARHHRLHTGEKSYKCEECDRVFSQKSNLERHKIIHTGEKPYKCNECHKTFSHRSSLPCHRRLHSGEKPYKCNECGKTFNVQSHLSRHHRLHTGEKPYKCKVCDKAFMCHSYLANHTRIHSGEKPYKCNECGKAHNHLIDSSIKPCMSS

SEQ ID NO: 17495 - protein, 590 aa, Homo sapiens; identical to SEQ ID NO: 17494

SEQ ID NO: 17496 - protein, 92 aa, Homo sapiens
MELVTFRDVAIEFSPEEWKCLDPAQQNLYRDVMLENYRNLVSLGFVISNPDLVTCLEQIKEPCNLKIHETAAKPPGSDLQVYKESQCPLYRL

SEQ ID NO: 17497 - protein, 904 aa, Homo sapiens
MAAAGGAEGRRADMEAEAAAAPEREGGSCVLCCGDLEATALGRCDHPVCYRCSTKMRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGCVGVPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHMEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 17498 - protein, 849 aa, Homo sapiens
MRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGCVGVPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHMEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 17499 - protein, 1512 aa, Homo sapiens
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKATNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRRE

SEQ ID NO: 17500 - protein, 1085 aa, Homo sapiens
MRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKATNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRRE

SEQ ID NO: 17501 - protein, 715 aa, Homo sapiens
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKE

SEQ ID NO: 17502 - protein, 707 aa, Homo sapiens
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLID

SEQ ID NO: 17503 - protein, 500 aa, Homo sapiens
LFLFLAVVCSYFAQDFWPKQGIKNCFQKVILKRYKKCGHENLQLGKYCKSMDECKVHEECYNGLNQCLRTTQSKILQCDKYVKVFHKFSNSNRYKIRHTGKKPFKCKECEKSFCMLSHLAQHKRIHTREKPYKCKECGKAYNEASNLSTHKRIHTGKKPYKCEQCGKAFNRLSHLTTHKIIHTGKKPYICEDCGKAFNQSANLTTHKRIHTGEKPYKCEESGKAFSQSSTLTTHKIIHAGEKPYKYEECGKSFNQSSTLTTRKIIHTGEKFCKCEEWGKAFSRLSHLTTHKRIHSGEKPYKCEECGKAFKQSSTLTTHKRIHSGEKFYKCEVCSKAFSRFSHLTTHKRIHSGEKPYKCEECGKAFNLSSHLTTHKIIHTGEKPYKCEECGKAFNLSSHLTTHKIIHTGEKPYKCEECGKAFNQSSTLSKHKVIHTGEKPYKCGECGKAFNQSSHLTTHKIIHTGEKPYKCEECGKAFNNSSILNRHKMIHTGEKFYKPES

SEQ ID NO: 17504 - protein, 412 aa, Homo sapiens
MTFTFQSEDLKRDCGKKMSHQHVFSLAMEEDVKTADTKKASRILDHEKENTRSICLLEQKRKVVSSNIDVPPARKSSEELDMDKVTAAMVLTSLSTSPLVRSPPVRPNESLSGSWKEGGCVPSSTSSSGYWSWSAPSDQSNPSTPSPPLSADSFKPFRSPAQPDDGIDEAEASNLLFDEPIPRKRKNSMKVMFKCLWKNCGKVLSTAAGIQKHIRTIHLGRVGDSDYSDGEEDFYYTEIKLNTDSVADGLSSLAPVSPSQSLASPPTFPIPDSSRTETPCAKTETKLMTPLSRSAPTTLYLVHTDHAYQATPPVTIPGSAKFTPNGSSFSISWQSPPVTFTGIPVSPTHHPVGTGEQRQHAHTVLSSPPRGTVSLRKPRGEGKKCRKVYGMENRDMWCTACRWKKACQRFLD

SEQ ID NO: 17505 - protein, 189 aa, Homo sapiens
MTFTFQSEDLKRDCGKKMSHQHVFSLAMEEDVKTADTKKASRILDHEKENTRSICLLEQKRKVVSSNIDVPPARKSSEELDMDKVTAAMVLTSLSTSPLVRSPPVRPNESLSGSWKEGGCVPSSTSSSGYWSWSAPSDQSNPSTPSPPLSADSFKPFRSPAQPDDGIDEAEASNLLFDEPIPRKRKNSM

SEQ ID NO: 17506 - protein, 300 aa, Homo sapiens
MHSLEKVTFEDVAIDFTQEEWDMMDTSKRKLYRDVMLENISHLVSLGYQISKSYIILQLEQGKELWWEGRVFLQDQNPDRESALKKKHMISMHPIIRKDTSTSMTMENSLILEDPFEYNDSGEDCTHSSTITQCLLTHSGKKPCVSKQCGKSLRNLLSPKPRKQIHTKGKSYQCNLCEKAYTNCFYLRRHKMTHTGERPYACHLCGKAFTQCSHLRRHEKTHTGERPYKCHQCGKAFIQSFNLRRHERTHLGQKCYECDKSGKAFSQSSGFRGNKIIHIGEKPPACLLCGKAFSLSSDLR

SEQ ID NO: 17507 - protein, 300 aa, Homo sapiens; identical to SEQ ID NO: 17506

SEQ ID NO: 17508 - protein, 300 aa, Homo sapiens
MHSLKKLTFEDVAIDFTQEEWAMMDTSKRKLYRDVMLENISHLVSLGYQISKSYIILQLEQGKELWREGRVFLQDQNPNRESALKKTHMISMHPITRKDASTSMTMENSLILEDPFECNDSGEDCTRSSTITQCLLTHSGKKPYVSKQCGKSLRNLLSTEPHKQIHTKGKSYQCNLCEKAYTNCFHLRRHKMTHTGERPYACHLCRKAFTQCSHLRRHEKTHTGQRPYKCHQYGKVFIQSFNLQRHERTHLGKKCYECDKSGKAFSQSSGFRGNKIIHTGEKPHACLLCGKAFSLSSNLR

SEQ ID NO: 17509 - protein, 300 aa, Homo sapiens; identical to SEQ ID NO: 17508

SEQ ID NO: 17510 - protein, 76 aa, Homo sapiens
MARGQQKIQSQQKNAKKQAGQKKKQGHDQKAAAKAALIYTCTVCRTQMPDPKTFKQHFESKHPKTPLPPELADVQA

SEQ ID NO: 17511 - protein, 76 aa, Homo sapiens; identical to SEQ ID NO: 17510

SEQ ID NO: 17512 - protein, 76 aa, Homo sapiens; identical to SEQ ID NO: 17510

SEQ ID NO: 17513 - protein, 76 aa, Homo sapiens; identical to SEQ ID NO: 17510

SEQ ID NO: 17514 - protein, 76 aa, Homo sapiens; identical to SEQ ID NO: 17510

SEQ ID NO: 17515 - protein, 8 aa, Homo sapiens
MARGQQKI

SEQ ID NO: 17516 - protein, 76 aa, Homo sapiens; identical to SEQ ID NO: 17510

SEQ ID NO: 17517 - protein, 76 aa, Homo sapiens; identical to SEQ ID NO: 17510

SEQ ID NO: 17518 - protein, 42 aa, Homo sapiens
MARGQQKIQSQQKNAKKQAGQKKKQGHDQKAAAKAALIYTCT

SEQ ID NO: 17519 - protein, 371 aa, Homo sapiens
MDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEV

SEQ ID NO: 17520 - protein, 371 aa, Homo sapiens; identical to SEQ ID NO: 17519

SEQ ID NO: 17521 - protein, 554 aa, Homo sapiens
MNVMLENYKNLVFLAGIAVSKQDPITSLEQEKEPWNMKICEMVDESPAMCSSFTRDLWPEQDIKDSFQQVILRRHGKCEHENLQLRKGSANVVECKVYKKGYELNQCLTTTQSKIFPCDKYIKVFHKIFNSNRHKTRHTGEKPFKCKKCDESFCMLLHLHQHKRIHIRENSYQCEECDKVFKRFSTLTRHKRVHTGEKPFKCEECGKAFKHSSTLTTHKMIHTGEKPYRCEECGKAFYHSSHLTTHKVIHTGEKPFKCEECGKAFNHPSALTTHKFIHVKEKPYKCEECDKAFNRFSYLTKHKIIHSGEKSYKCEQCGKGFNWSSTLTKHKRIHTGEKPYKCEECGKAFNVSSHLTTHKMIHTGEKPYKCEECGKAFNHSSKLTIHKIIHTGEKPYKCEECGKAFNQSSNLTKHKIIHTGEKLYKCEECGKAFNRSSNLTTHKRIHTGEKPYKCEECGKAFNRSSNLTKHNIIHTGEKSYKCEECGKAFNQSSTLTKHRKIQQGMVAHACNPNTLRGLGEQIARSGVQDQPGQHGKTPSLLKIQKFAGCGGRRL

SEQ ID NO: 17522 - protein, 523 aa, Homo sapiens
MNVMLENYKNLVFLAGIAVSKQDPITSLEQEKEPWNMKICEMVDESPAMCSSFTRDLWPEQDIKDSFQQVILRRHGKCEHENLQLRKGSANVVECKVYKKGYELNQCLTTTQSKIFPCDKYIKVFHKIFNSNRHKTRHTGEKPFKCKKCDESFCMLLHLHQHKRIHIRENSYQCEECDKVFKRFSTLTRHKRVHTGEKPFKCEECGKAFKHSSTLTTHKMIHTGEKPYRCEECGKAFYHSSHLTTHKVIHTGEKPFKCEECGKAFNHPSALTTHKFIHVKEKPYKCEECDKAFNRFSYLTKHKIIHSGEKSYKCEQCGKGFNWSSTLTKHKRIHTGEKPYKCEECGKAFNVSSHLTTHKMIHTGEKPYKCEECGKAFNHSSKLTIHKIIHTGEKPYKCEECGKAFNQSSNLTKHKIIHTGEKLYKCEECGKAFNRSSNLTTHKRIHTGEKPYKCEECGKAFNRSSNLTKHNIIHTGEKSYKCEECGKAFNQSSTLTKHRKIQQGMVAHACNPNTLRGQGRWIM

SEQ ID NO: 17523 - protein, 554 aa, Homo sapiens; identical to SEQ ID NO: 17521

SEQ ID NO: 17524 - protein, 483 aa, Homo sapiens
MGLLTFRDIAIEFSLAEWQCLDHAQQNLYRDVMLENYRNLVSLGIAVSKPDLITCLEQNKEPQNIKRNEMVAKHPVTCSHFTQDLQSEQGIKDSLQKVILRRYGKCGQEDLQVKKCCKSVGECEVHKGGYNYVNQCLSATQNKTFQTHKCVKVFGKFSNSNRHKTRHTGKKHFKCKNDGKSFCMLSRLNQHQIIHTREKSYKCEECGKSFNCSSTLTRHKRIHTGEKPYRCEECGKAFSWSASLTKHKRIHTGEKPYTCEERGKVFSRSTLTNYKRIHTGEKPYTCEECGKAFSRSSTLTNHKRIHTGERPYKCEECGKAFSLSSTLKKHKIVHTGEKLYTCEECGKAFTFSSTLNTHKRIHTGEKPYTCEECGKAFSLPSTFTYHKRTHTGEKPYKCEECGKAFNCSSTLKKHKIIHTGEKLYKCKECGKAFTFSSTLNTHKRIHTGEKPYKCEECDQTFKWHSSLANHKNMHTGEKPYKYE

SEQ ID NO: 17525 - protein, 495 aa, Homo sapiens
MAKRPGPPGSREMGLLTFRDIAIEFSLAEWQCLDHAQQNLYRDVMLENYRNLVSLGIAVSKPDLITCLEQNKEPQNIKRNEMVAKHPVTCSHFTQDLQSEQGIKDSLQKVILRRYGKCGQEDLQVKKCCKSVGECEVHKGGYNYVNQCLSATQNKTFQTHKCVKVFGKFSNSNRHKTRHTGKKHFKCKNDGKSFCMLSRLNQHQIIHTREKSYKCEECGKSFNCSSTLTRHKRIHTGEKPYRCEECGKAFSWSASLTKHKRIHTGEKPYTCEERGKVFSRSTLTNYKRIHTGEKPYTCEECGKAFSRSSTLTNHKRIHTGERPYKCEECGKAFSLSSTLKKHKIVHTGEKLYTCEECGKAFTFSSTLNTHKRIHTGEKPYTCEECGKAFSLPSTFTYHKRTHTGEKPYKCEECGKAFNCSSTLKKHKIIHTGEKLYKCKECGKAFTFSSTLNTHKRIHTGEKPYKCEECDQTFKWHSSLANHKNMHTGEKPYKYE

SEQ ID NO: 17526 - protein, 907 aa, Homo sapiens
MLETYNSLVSLQELVSFEEVAVHFTWEEWQDLDDAQRTLYRDVMLETYSSLVSLGHYITKPEMIFKLEQGAEPWIVEETPNLRLSAVQIIDDLIERSHESHDRFFWQIVITNSNTSTQERVELGKTFNLNSNHVLNLIINNGNSSGMKPGQFNDCQNMLFPIKPGETQSGEKPHVCDITRRSHRHHEHLTQHHKIQTLLQTFQCNEQGKTFNTEAMFFIHKRVHIVQTFGKYNEYEKACNNSAVIVQVITQVGQPTCCRKSDFTKHQQTHTGEKPYECVECEKPSISKSDLMLQCKMPTEEKPYACNWCEKLFSYKSSLIIHQRIHTGEKPYGCNECGKTFRRKSFLTLHERTHTGDKPYKCIECGKTFHCKSLLTLHHRTHSGEKPYQCSECGKTFSQKSYLTIHHRTHTGEKPYACDHCEEAFSHKSRLTVHQRTHTGEKPYECNECGKPFINKSNLRLHQRTHTGEKPYECNECGKTFHRKSFLTIHQWTHTGEKPYECNECGKTFRCKSFLTVHQRTHAGEKPYACNECGKTYSHKSYLTVHHRTHTGEKPYECNECGKSFHCKSFLTIHQRTHAGKKPYECNECEKTFINKLNLGIHKRTHTGERPYECNECGKTFRQKSNLSTHQGTHTGEKPYVCNECGKTFHRKSFLTIHQRTHTGKNRMDVMNVEKLFVRNHTLLYIRELTPGKSPMNVMNVENPFIRRQIFRSIKVFTRGRNPMNVANVEKPCQKSVLTVHHRTHTGEKPYECNECGKTFCHKSNLSTHQGTHSGEKPYECDECRKTFYDKTVLTIHQRTHTGEKPFECKECRKTFSQKSKLFVHHRTHTGEKPFRCNECRKTFSQKSGLSIHQRTHTGEKPYECKECGKTFCQKSHLSRHQQTHIGEKSDVAEAGYVFPQNHSFFP

SEQ ID NO: 17527 - protein, 914 aa, Homo sapiens
MFPVFSGCFQELQEKNKSLELVSFEEVAVHFTWEEWQDLDDAQRTLYRDVMLETYSSLVSLGHYITKPEMIFKLEQGAEPWIVEETPNLRLSAVQIIDDLIERSHESHDRFFWQIVITNSNTSTQERVELGKTFNLNSNHVLNLIINNGNSSGMKPGQFNDCQNMLFPIKPGETQSGEKPHVCDITRRSHRHHEHLTQHHKIQTLLQTFQCNEQGKTFNTEAMFFIHKRVHIVQTFGKYNEYEKACNNSAVIVQVITQVGQPTCCRKSDFTKHQQTHTGEKPYECVECEKPSISKSDLMLQCKMPTEEKPYACNWCEKLFSYKSSLIIHQRIHTGEKPYGCNECGKTFRRKSFLTLHERTHTGDKPYKCIECGKTFHCKSLLTLHHRTHSGEKPYQCSECGKTFSQKSYLTIHHRTHTGEKPYACDHCEEAFSHKSRLTVHQRTHTGEKPYECNECGKPFINKSNLRLHQRTHTGEKPYECNECGKTFHRKSFLTIHQWTHTGEKPYECNECGKTFRCKSFLTVHQRTHAGEKPYACNECGKTYSHKSYLTVHHRTHTGEKPYECNECGKSFHCKSFLTIHQRTHAGKKPYECNECEKTFINKLNLGIHKRTHTGERPYECNECGKTFRQKSNLSTHQGTHTGEKPYVCNECGKTFHRKSFLTIHQRTHTGKNRMDVMNVEKLFVRNHTLLYIRELTPGKSPMNVMNVENPFIRRQIFRSIKVFTRGRNPMNVANVEKPCQKSVLTVHHRTHTGEKPYECNECGKTFCHKSNLSTHQGTHSGEKPYECDECRKTFYDKTVLTIHQRTHTGEKPFECKECRKTFSQKSKLFVHHRTHTGEKPFRCNECRKTFSQKSGLSIHQRTHTGEKPYECKECGKTFCQKSHLSRHQQTHIGEKSDVAEAGYVFPQNHSFFP

SEQ ID NO: 17528 - protein, 126 aa, Homo sapiens
MGLLTFRDVAIEFSREEWEHLDSDQKLLYGDVMLENYGNLVSLGLAVSKPDLITFLEQRKEPWNVKSAETVAIQPDIFSHDTQGLLRKKLIEASFQKVILDGYGSCGPQNLNLRKEWESEGKIILW

SEQ ID NO: 17529 - protein, 178 aa, Homo sapiens
MVNVPDIFSHDTQGLLRKKLIEASFQKVILDGYGSCGPQNLNLRKEWESEGKCEGHNGYYDGHTKCKTTTYNKNLTVTGGQKHEKTQFMSVAFSKPCVSVSKCQHQFLKLTFSFKGNLDNPNSDLVHVSNNHLNQLKYRTGVNVQSNISEKERFKNEEVISKYDQFDGSLLKVCFTNK

SEQ ID NO: 17530 - protein, 475 aa, Homo sapiens
MSLATVDTLYIFSHDTQGLLRKKLIEASFQKVILDGYGSCGPQNLNLRKEWESEEKNQYNKSDTTLSQGISPRRHQKTHFLHNHCKRKKCEKAFHECTNHVHQSIFIQEKSAKCNKCIETFIQSSKHTQPQRIHIGEKSHRCNNGEKILSKLSSLRKHKIIHNEEKPYKCKECDKAFNHRSHLTQHQIIHTGEKPYKCKECGKAFNSSSYFTRHQRIHTGEKLYKCKACSKCFTHSSNLLVHQRIHTGEKPYKCKECGKSFKVSSALTQHERIHTGEKPYKCKECSKAFNCRSYLTKHQRIHTGEKLYKCKSCSKSFSRSSSLIVHQRIHTGEKPYKCKECGKAFNCSSRLTQHQRIHTGEKPYICKECGKAFNCSSSLTKHQRIHTGVKLYKCKACSKSFSHSSCLSVHQITHTGMKPYICKDCGISFNRSSNLRRHQMIHTGEKPYKCKECGKLFNRCSTLTRHKSIHTREFL

SEQ ID NO: 17531 - protein, 619 aa, Homo sapiens
MGPLTFMDVAIEFSVEEWQCLDTAQQNLYRNVMLENYRNLVFLGIAVSKPDLITCLEQGKEPWNMERHEMVAKPPGMCCYFAQDLRPEQSIKASLQRIILRKYEKCGHHNLQLKKGYKSVDEYKVHKGSYNGFNQCLTTTQSKIFQCDKYVKDFHKFSNSNRHKTEKNPFKCKECGKSFCVLSHLTQHKRIHTTVNSYKLEECGKAFNVSSTLSQHKRIHTGQKHYKCEECGIAFNKSSHLNTHKIIHTGEKSYKREECGKAFNISSHLTTHKIIHTGENAYKCKECGKAFNQSSTLTRHKIIHAGEKPYICEHCGRAFNQSSNLTKHKRIHTGDKPYKCEECGKAFNVSSTLTQHKRIHTGEKPYKCEECGKAFNVSSTLTQHKRIHTGEKPYKCEECGKAFNTSSHLTTHKRIHTGEKPYKCEECGKAFNQFSQLTTHKIIHTGEKPYKCKECGKAFKRSSNLTEHRIIHTGEKPYKCEECGKAFNLSSHLTTHKKIHTGEKPYKCKECGKAFNQSSTLARHKIIHAGEKPYKCEECGKAFYQYSNLTQHKIIHTGEKPYKCEECGKAFNWSSTLTKHKVIHTGEKPYKCKECGKAFNQCSNLTTHKKIHAVEKSDK

SEQ ID NO: 17532 - protein, 499 aa, Homo sapiens
MRVLTFRDVAVEFSPEEWECLDSAQQRLYRDVMLENYGNLFSLGLAIFKPDLITYLEQRKEPWNARRQKTVAKHPAGSLHFTAEILLEHDINDSFQKVILRKSGSCDLNTLRLKKDYQRVGNCKGQKSSYNGIHQCLSATRSKTCQYNKCGKAFGLCSIFTEHKKIFSREKCYKCEECGKDCRLSDFTIQKRIHTADRSYKCEECGKACKKFSNLTEHNRVHTGKKPYKCEECGKTFTCSSALTKHKRNHTGDRPYKCEECHKAFRCCSDLTKHKRIHTGEKPYKCKECHKAFRCCSDLTKHKRIHTGEKPYKCNECGKAFMWISALSQHNRIHTGEKPYICEECGKAFTYSSTLISHKRIHMELRPYKCEECGKTFKWFSDLTNHKRIHTGEKPYKCEECGKSFTCSSNLIKHKRIHMEVRPYKCEECGKTFKWFPDLTNHKRIHTGEKPYKCEECGKTFTCSSSLIKHKRSHTGDRPTSAKNVAKPLGGSQTLLNIR

SEQ ID NO: 17533 - protein, 622 aa, Homo sapiens
MGSLTFRDVAIQFSLEEWQCLDTAQQNLYRNVMLENYRNLVFLGIAAPKPDLIIFLEQGKEPWNMKRHELVKEPPVICSHFAQDLWPEQGREDSFQKVILRRYEKCGHENLQLKIGCTNVDECKVHKKGYNKLNQSLTTTQSKVFQCGKYANIFHKCSNSKRHKIRHTGKKLLKCKEYVRSFCMLSHLSQHKRIYTRENSYKSEEHGKAFNWSSALTYKRIHTGEKPCKCEECGKAFSKFSILTKHKVIHTGEKHYKCEECGKAFTRSSSLIEHKRSHAGEKPYKCEECGKAFSKASTLTAHKTIHAGEKPYKCEECGKAFNRSSNLMEHKRIHTGEKPCKCEECGKAFGNFSTLTKHKVIHTGEKPYKCEECGKAFSWPSSLTEHKRIHAGDKPYKCEECGKTFKWSSTLTKHKIIHTGEKPYKCEECGKAFTTFSSLTKHKVIHTGEKHYKCEECGKVFSWSSSLTTHKAIHAGEKLYKCEECGKAFKWSSNLMEHKRIHTGEKPYKCEECGKAFSKVANLTKHKVIHTGEKQYKCEECGKAFIWSSRLSEHKRIHTGEKPYKCEECGKAFSWVSVLNKHKKIHAGKKFYKCEECGKDFNQSSHLTTHKRIHTGGKTLQM

SEQ ID NO: 17534 - protein, 1173 aa, Homo sapiens
MPGAPGSLEMGPLTFRDVTIEFSLEEWQCLDTVQQNLYRDVMLENYRNLVFLGMAVFKPDLITCLKQGKEPWNMKRHEMVTKPPVMRSHFTQDLWPDQSTKDSFQEVILRTYARCGHKNLRLRKDCKSANEGKMHKEGYNKLNQCRTATQRKIFQCNKHMKVFHKYSNRNKVRHTKKKTFKCIKCSKSFFMLSCLIRHKRIHIRQNIYKCEERGKAFKSFSTLTKHKIIHTEDKPYKYKKCGNAFKFSSTFTKHKRIHTGETPFRCEECGKAFNQSSNLTDHKRIHTGEKTYKCEECGKAFKGSSNFNAHKVIHTAEKPYKCEDCGKTFNHFSALRKHKIIHTGKKPYKREECGKAFSQSSTLRKHEIIHTGEKPYKCEECGKAFKWSSKLTVHKVVHTGEKPYKCEECGKAFSQFSTLKKHKIIHTGKKPYKCEECGKAFNSSSTLMKHKIIHTGEKPYKCEECGKAFRQSSHLTRHKAIHTGEKPYKCEECGKAFNHFSDLRRHKIIHTGKKPYKCEECGKAFSQSSTLRNHQIIHTGEKPYKCEECGKAFKWSSKLTVHKVIHTGEKPCKCEECGKAFKHFSALRKHKVIHTREKLYKCEECGKAFNNSSILAKHKIIHTGKKPYKCEECGKAFRQSSHLTRHKAIHTGEKPYKCEECGKAFSHFSALRRHKIIHTGKKPYKCEECGKAFSHFSALRRHKIIHTGEKPYKCEECGKAFKWSSKLTVHKVIHTAEKPCKCEECGKSFKHFSALRKHKVIHTREKLYKCEECVKAFNSFSALMKHKVIHTGEKPYKCEECGKAFKWSSKLTVHKVIHTGEKPCKCEECGKAFKHFSALRKHKVIHTGKKPYKCEECGKAFSQSSSLRKHEIIHSGEKPYKCEECGKAFKWLSKLTVHKIIHTGKKPYKCEECGKAFNDSSTLMKHKIIHTGKKPYKCAECGKAFKQSSHLTRHKAIHTGEKPYKCEECGKDFNNSSTLKKHKLIHTREKLYKCEECVKAFNNFSALMKHKIIHTGEKPYKCEECGKAFKWSSKLTEHKVIHTGEKPCKCEECDKAFKHFSALRKHKVIHTGKKPYQCDECGKAFNNSSTLTKHKIIHTGEKPYKCEECGKAFSQSSILTKHKIIHSVEKPYKCEECGKAFNQSSHLTRHKTIHTGEKPYKYKTIHTGEKPYK

SEQ ID NO: 17535 - protein, 1252 aa, Homo sapiens
MPGAPGSLEMGPLTFRDVTIEFSLEEWQCLDTVQQNLYRDVMLENYRNLVFLGMAVFKPDLITCLKQGKEPWNMKRHEMVTKPPVMRSHFTQDLWPDQSTKDSFQEVILRTYARCGHKNLRLRKDCKSANEGKMHKEGYNKLNQCRTATQRKIFQCNKHMKVFHKYSNRNKVRHTKKKTFKCIKCSKSFFMLSCLIRHKRIHIRQNIYKCEERGKAFKSFSTLTKHKIIHTEDKPYKYKKCGNAFKFSSTFTKHKRIHTGETPFRCEECGKAFNQSSNLTDHKRIHTGEKTYKCEECGKAFKGSSNFNAHKVIHTAEKPYKCEDCGKTFNHFSALRKHKIIHTGKKPYKREECGKAFSQSSTLRKHEIIHTGEKPYKCEECGKAFKWSSKLTVHKVVHTGEKPYKCEECGKAFSQFSTLKKHKIIHTGKKPYKCEECGKAFNSSSTLMKHKIIHTGEKPYKCEECGKAFRQSSHLTRHKAIHTGEKPYKCEECGKAFNHFSDLRRHKIIHTGKKPYKCEECGKAFSQSSTLRNHQIIHTGEKPYKCEECGKAFKWSSKLTVHKVIHTGEKPCKCEECGKAFKHFSALRKHKVIHTREKLYKCEECGKAFNNSSILAKHKIIHTGKKPYKCEECGKAFRQSSHLTRHKAIHTGEKPYKCEECGKAFSHFSALRRHKIIHTGKKPYKCEECGKAFSHFSALRRHKIIHTGEKPYKCEECGKAFKWSSKLTVHKVIHTAEKPCKCEECGKSFKHFSALRKHKVIHTREKLYKCEECVKAFNSFSALMKHKVIHTGEKPYKCEECGKAFKWSSKLTVHKVIHTGEKPCKCEECGKAFKHFSALRKHKVIHTGKKPYKCEECGKAFSQSSSLRKHEIIHSGEKPYKCEECGKAFKWLSKLTVHKVIHTAEKPCKCEECGKAFKHFSALRKHKIIHTGKKPYKCEECGKAFNDSSTLMKHKIIHTGKKPYKCAECGKAFKQSSHLTRHKAIHTGEKPYKCEECGKDFNNSSTLKKHKLIHTREKLYKCEECVKAFNNFSALMKHKIIHTGEKPYKCEECGKAFKWSSKLTEHKVIHTGEKPCKCEECDKAFKHFSALRKHKVIHTGKKPYQCDECGKAFNNSSTLTKHKIIHTGEKPYKCEECGKAFSQSSILTKHKIIHSVEKPYKCEECGKAFNQSSHLTRHKTIHTGEKPYKCEECGKAFIQCSYLIRHKTIHTREKPTNVKKVPKLLSNPHTLLDKTIHTGEKPYKCEECAKAF

SEQ ID NO: 17536 - protein, 191 aa, Homo sapiens
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRIRRWRSVRQKRTQQIPETRKRKDKGKGREPWRSPTLWPPGLLG

SEQ ID NO: 17537 - protein, 190 aa, Homo sapiens
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRIRRWRSVRQKRTQIPETRKRKDKGKGREPWRSPTLWPPGLLG

SEQ ID NO: 17538 - protein, 330 aa, Homo sapiens
MTDPSLGLTVPMAPPLAPLPPRDPNGAGSEWRKPGAVSFADVAVYFSREEWGCLRPAQRALYRDVMRETYGHLGALGVGGSKPALISWVEEKAELWDPAAQDPEVAKCPTEADPDSRNKEEERQREGTGALEKPDPVAAGSPGLKAPQAPFAGLEQLSKARRRSRPRFFAHPPVPRADQRHGCYVCGKSFAWRSTLVEHIYSHRGEKPFHCADCGKGFGHASSLSKHRAIHRGERPHRCPECGRAFMRRTALTSHLRVHTGEKPYRCPQCGRCFGLKTGMAKHQWVHRPGGEGRRGRRPGGLSVTLTPVRGDLDPPVGFQLYPEIFQECG

SEQ ID NO: 17539 - protein, 831 aa, Homo sapiens
MENQRSSPLSFPSVPQEETLRQAPAGLPRETLFQSRVLPPKEIPSLSPTIPRQGSLPQTSSAPKQETSGRMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGFQDSELGDPCGEQPDLDMQEPENTLEESTEGSSEFSELKQMLVQQRNCTEGIVIKTEEQDEEEEEEEEDELPQHLQSLGQLSGRYEASMYQTPLPGEMSPEGEESPPPLQLGNPAVKRLAPSVHGERHLSENRGASSQQQRNRRGERPFTCMECGKSFRLKINLIIHQRNHIKEGPYECAECEISFRHKQQLTLHQRIHRVRGGCVSPERGPTFNPKHALKPRPKSPSSGSGGGGPKPYKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPHACPECGKSFIRKHHLLEHRRIHTGERPYHCAECGKRFTQKHHLLEHQRAHTGERPYPCTHCAKCFRYKQSLKYHLRTHTGE

SEQ ID NO: 17540 - protein, 524 aa, Homo sapiens
MENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGFQDSELGDPCGEQPDLDMQEPENTLEESTEGSSEFSELKQMLVQQRNCTEGIVIKTEEQDEEEEEEEEDELPQHLQSLGQLSGRYEASMYQTPLPGEMSPEGEESPPPLQLGNPAVKRLAPSVHGERHLSENRGASSQQQRNRRGERPFTCMECGKSFRLKINLIIHQRNHIKEGPYECAECEISFRHKQQLTLHQRIHRVRGGCVSPERGPTFNPKHALKPRPKSPSSGSGGGGPKPYKCPECDSSFSHKSSLTKHQITHTGERPYTCPDAAARPGARAVPPLGHRQARAQRAGRGAPQPLCRELPLSSRPSSQGHGGSETRSLAAAFPRGPQGGGRGPGEPFRAVNFLDNKMDETNQHGGRDLAAGHSEGRCRAHLVGDRTL

SEQ ID NO: 17541 - protein, 327 aa, Homo sapiens
MQRNAMYLKNVAETACNFQLTQYQISHANQKPYECQICGKPFRKRAHLTQHNRIHTGGKPYECKECGKVFICCSTLIQHKRTHTSEKPYECLECRKTFRRSAHLIRHQRIHTGEKPYKCKQCWKAFASVSDLIDIGKFTLMRDFTNVQNVGRHLTIAQLLFSIREFTLVRSPLNVRNVAKHSIIAQHLLNTRELILMRNLMNVRNVKRLLGKVHILLNIKEFILVRNHMSVSNVGRLSLVFLILIDIREFTLVKNPMNVKNVVELLTIVQLLFNTREFTLVRRLMNISSVGRFLSPVQHLFNIREHILMKNLMNVSNARRPSSIMHI

SEQ ID NO: 17542 - protein, 353 aa, Homo sapiens
MQRNAMYLKNVAETACNFQLTQYQISHANQKPYECQICGKPFRKRAHLTQHNRIHTGGKPYECKECGKVFICCSTLIQHKRTHTSEKPYECLECRKTFRRSAHLIRHQRIHTGEKPYKCKQCWKAFASVSDLIDIGKFTLMRDFTNVQNVGRHLTIAQLLFSIREFTLVRSPLNVRNVAKHSIIAQHLLNTRELILMRNLMNVRNVKRLLGKVHILLNIKEFILVRNHMSVSNVGRLSLVFLILIDIREFTLVKNPMNVKNVVELLTIVQLLFNTREFTLVRRLMNISSVGRFLSPVQHLFNIREHILMKNLMNVSNARRPSSIMHIDIREFTVGRNPMNVMNVGMPSFVFLI

SEQ ID NO: 17543 - protein, 373 aa, Homo sapiens
LEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAISKKTLPKEKSCEYNKFGKISLLSTDLFSSIQSPSNWNPCGKNLNHNLDLIGFKRNCAKKQDECYAYGKLLQRINHGRRPNGEKPRGCSHCEKAFTQNPALMYKPAVSDSLLYKRKRVPPTEKPHVCSECGKAFCYKSEFIRHQRSHTGEKPYGCTDCGKAFSHKSTLIKHQRIHTGVRPFECFFCGKAFTQKSHRTEHQRTHTGERPFVCSECGKSFGEKSYLNVHRKMHTGERPYRCRECGKSFSQKSCLNKHWRTHFGESSLRSKSSNT

SEQ ID NO: 17544 - protein, 374 aa, Homo sapiens
MIEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAISKKTLPKEKSCEYNKFGKISLLSTDLFSSIQSPSNWNPCGKNLNHNLDLIGFKRNCAKKQDECYAYGKLLQRINHGRRPNGEKPRGCSHCEKAFTQNPALMYKPAVSDSLLYKRKRVPPTEKPHVCSECGKAFCYKSEFIRHQRSHTGEKPYGCTDCGKAFSHKSTLIKHQRIHTGVRPFECFFCGKAFTQKSHRTEHQRTHTGERPFVCSECGKSFGEKSYLNVHRKMHTGERPYRCRECGKSFSQKSCLNKHWRTHTGESLEPRRQRLQ

SEQ ID NO: 17545 - protein, 406 aa, Homo sapiens
MIEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAISKKTLPKEKSCEYNKFGKISLLSTDLFSSIQSPSNWNPCGKNLNHNLDLIGFKRNCAKKQDECYAYGKLLQRINHGRRPNGEKPRGCSHCEKAFTQNPALMYKPAVSDSLLYKRKRVPPTEKPHVCSECGKAFCYKSEFIRHQRSHTGEKPYGCTDCGKAFSHKSTLIKHQRIHTGVRPFECFFCGKAFTQKSHRTEHQRTHTGERPFVCSECGKSFGEKSYLNVHRKMHTGERPYRCRECGKSFSQKSCLNKHWRTHTGEKPYGCNECGKAFYQKPNLSRHQKIHARKNAYRNENLIIVGNT

SEQ ID NO: 17546 - protein, 406 aa, Homo sapiens; identical to SEQ ID NO: 17545

SEQ ID NO: 17547 - protein, 1349 aa, Homo sapiens
MACYLVISSRHLSNGHYRGIKGVFRGPLCKNGSPSPDFAEKKSTAKALEDVKANFYCELCDKQYHKHQEFDNHINSYDHAHKQRLKELKQREFARNVASKSWKDEKKQEKALKRLHQLAELRQQSECVSGNGPAYKAPRVAIEKQLQQGIFPIKNGRKVSCMKSALLLKGKNLPRIISDKQRSTMPNRHQLQSDRRCLFGNQVLQTSSDLSNANHRTGVSFTFSKKVHLKLESSASVFSENTEETHDCNKSPIYKTKQTADKCKCCRFANKDTHLTKEKEVNISPSHLESVLHNTISINSKILQDKHDSIDETLEDSIGIHASFSKSNIHLSDVDFTPTSREKETRNTLKNTLENCVNHPCQANASFSPPNIYNHSDARISECLDEFSSLEPSEQKSTVHLNPNSRIENREKSLDKTERVSKNVQRLVKEACTHNVASKPLPFLHVQSKDGHTTLQWPTELLLFTKTEPCISYGCNPLYFDFKLSRNTKEDHNLEDLKTELGKKPLELKTKRESQVSGLTEDQQKLIQEDYQYPKPKTMIANPDWEKFQRKYNLDYSDSEPNKSEYTFSANDLEMKNPKVPLYLNTSLKDCAGKNNSSENKLKEASRAHWQGCRKAVLNDIDEDLSFPSYISRFKKHKLIPCSPHLEFEDERQFNCKSSPCTVGGHSDHGKDFSVILKSNHISMTSKVSGCGNQRYKRYSPQSCLSRYSSSLDTSPSSMSSLRSTCSSHRFNGNSRGNLLCFHKREHHSVERHKRKCLKHNCFYLSDDITKSSQMQSEPQKERNCKLWESFKNEKYSKRRYCHCRERQKLGKNQQQFSGLKSTRIIYCDSNSQISCTGSSKKPPNCQGTQHDRLDSYSIEKMYYLNKSKRNQESLGSPHICDLGKVRPMKCNSGNISCLLKNCSSGPSETTESNTAEGERTPLTAKILLERVQAKKCQEQSSNVEISSNSCKSELEAPSQVPCTIQLAPSGCNRQALPLSEKIQYASESRNDQDSAIPRTTEKDKSKSSHTNNFTILADTDCDNHLSKGIIHLVTESQSLNIKRDATTKEQSKPLISEIQPFIQSCDPVPNEFPGAFPSNKYTGVTDSTETQEDQINLDLQDVSMHINHVEGNINSYYDRTMQKPDKVEDGLEMCHKSISPPLIQQPITFSPDEIDKYKILQLQAQQHMQKQLLSKHLRVLPAAGPTAFSPASTVQTVPVHQHTSITTIHHTFLQHFAVSASLSSHSSHLPIAHLHPLSQAHFSPISFSTLTPTIIPAHPTFLAGHPLHLVAATPFHPSHITLQPLPPTAFIPTLFGPHLNPATTSIIHLNPLIQPVFQGQDFCHHSCSSQMQQLNEVKEALNVSTHLN

SEQ ID NO: 17548 - protein, 661 aa, Homo sapiens
MPANEDAPQPGEHGSACEVSVSFEDVTVDFSREEWQQLDSTQRRLYQDVMLENYSHLLSVGFEVPKPEVIFKLEQGEGPWTLEGEAPHQSCSDGKFGIKPSQRRISGKSTFHSEMEGEDTRDDSLYSILEELWQDAEQIKRCQEKHNKLLSRTTFLNKKILNTEWDYEYKDFGKFVHPSPNLILSQKRPHKRDSFGKSFKHNLDLHIHNKSNAAKNLDKTIGHGQVFTQNSSYSHHENTHTGVKFCERNQCGKVLSLKHSLSQNVKFPIGEKANTCTEFGKIFTQRSHFFAPQKIHTVEKPHELSKCVNVFTQKPLLSIYLRVHRDEKLYICTKCGKAFIQNSELIMHEKTHTREKPYKCNECGKSFFQVSSLLRHQTTHTGEKLFECSECGKGFSLNSALNIHQKIHTGERHHKCSECGKAFTQKSTLRMHQRIHTGERSYICTQCGQAFIQKAHLIAHQRIHTGEKPYECSDCGKSFPSKSQLQMHKRIHTGEKPYICTECGKAFTNRSNLNTHQKSHTGEKSYICAECGKAFTDRSNFNKHQTIHTGEKPYVCADCGRAFIQKSELITHQRIHTTEKPYKCPDCEKSFSKKPHLKVHQRIHTGEKPYICAECGKAFTDRSNFNKHQTIHTGDKPYKCSDCGKGFTQKSVLSMHRNIHT

SEQ ID NO: 17549 - protein, 454 aa, Homo sapiens
MAVTDLSHGFFPREPICPFEEKTKIGTMVEDYLANSYQDSVTFDDVAVEFTPEEWALLDTTEKCLYRDVMLENYVNLASVEATVDGNSENCGEVFSEWFCLKTHMRAQNGGNIFEGNCYGKDILSVHKEASIGQELSKFNPCGKVFTLTPDLAAHLGILNARQPYKCKECRKGFKYFASLDNHMGIHIGEKFCEFQECRRAITHSSHLKQCVTVHTGKKSKKTKKHGKSFTNFSQLSAHVKIHKGEKSFECKECGRSFRNSSSFNVHIQIHTGIKPHKYTECGKAFTRSTHLTQHVRTHTGIKPYECKECGQAFTQYTGLAIHIRNHTGEKHYQCKECGKAFNGSSTLTQHKIIHTGEKPYGCVECGKTFITSSYRSKHLKTHHEERPFVCKICGKAFLYSSPLNVHLQTHTREKALICKECGKAFAVSSHLSRHERIHTGEEPYEYKGMNVTI

SEQ ID NO: 17550 - protein, 577 aa, Homo sapiens [sequence omitted]

SEQ ID NO: 17551 - protein, 855 aa, Homo sapiens
MAAAATLRLSAQGTVTFEDVAVNFTWEEWNLLSEAQRCLYRDVTLENLALISSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLPRSGLLQQEASHTGEKSNSKTECVSPIQCGGAHYSCGESMKHFSTKHILSQHQRLLTREECYVCCECGKSFSKYASLSNHQRVHTEKKHECGECGKSFSKYVSFSNHQRVHTEKKHECGECGKSFSKYVSFSNHQRVHTGKRPYECGECGKSFSKYASFSNHQRVHTEKKHYECGECGKSFSKYVSFSNHQRVHTGKRPYECGECGKSFSKYASFSNHQRVHTDKKHYECGECGKSFSQKSSLIQHQRFHTGEKPYGCEECGKSFSSEGHLRSHQRVHAGERPFKCGECVKSFSHKRSLVHHQRVHSGERPYQCGECGKSFSQKGNLVLHQRVHTGARPYECGECGKSFSSKGHLRNHQQIHTGDRLYECGECGKSFSHKGTLILHQRVHPRERSYGCGECGKSFSSIGHLRSHQRVHTGERPYECGECGKSFSHKRSLVHHQRMHTGERPYKCGDCGKSFNEKGHLRNHQRVHTTERPFKCGECGKCFSHKGNLILHQHGHTGERPYVCRECGKLFKKKSHLLVHQRIHNGEKPYACEACQKFFRNKYQLIAHQRVHTGERPYECNDCGKSFTHSSTFCVHKRIHTGEKPYECSECGKSFAESSSFTKHKRVHTGEKPYECSECGKSFAESSSLTKHKRVHTGEKPYKCEKCGKLFNKKSHLLVHQSSHWRKAI

SEQ ID NO: 17552 - protein, 370 aa, Homo sapiens
MSRRKQTNPNKVHCDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 17553 - protein, 412 aa, Homo sapiens
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 17554 - protein, 370 aa, Homo sapiens; identical to SEQ ID NO: 17552

SEQ ID NO: 17555 - protein, 138 aa, Homo sapiens
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEARNLNSDPLLELCQCPLCQLDCGSREQLIAHVYQ

SEQ ID NO: 17556 - protein, 412 aa, Homo sapiens; identical to SEQ ID NO: 17553

SEQ ID NO: 17557 - protein, 559 aa, Homo sapiens
VPGSQCDPEKRCEIKTAAQGSRMEGLLSVALQGAELEGNWKHEGQVEDLQENQESCPEPEAVACKGDPAGDSMQERDEFSRIPRTISSPAATQASVPDDSSSRRCSAPGESPKERHPDSRQRERGGGPKKPWKCGDCGKAFSYCSAFILHQRIHTGEKPFACPECGKAFSQSVHLTLHQRTHTGEKPYACHECGKAFSQGSYLASHWRTHTGEKPHRCADCGKAFTRVTHLTQHRRVHTGERPYACAQCAKAFRNRSSLIEHQRIHTGEKPYECSACAKAFRFSSALIRHQRIHTEEKPYRCGQCAKAFAQIAHLTQHRRVHTGEKPYTCQDCGALFSQSASLAEHRRIHTGEKPYACGQCAKAFTQVSHLTQHQRTHTGERPYPCHDCGKRFSNRSHLLQHRLVHTGERPYRCLQCGAAFSHVSSLIEHQKIHTGERPYKCGECGKAFSQGSSLALHQRTHTGERPYTCPECGKAFSNRSYLIQHHIVHTGEKPYECSGCGKAFSFSSALIRHQRTHADSSGRLCPAPTPDSTPGLSQGGETCQQGCPGRNPRGPAED

SEQ ID NO: 17558 - protein, 537 aa, Homo sapiens
MEGLLSVALQGAELEGNWKHEGQVEDLQENQESCPEPEAVACKGDPAGDSMQERDEFSRIPRTISSPAATQASVPDDSSSRRCSAPGESPKERHPDSRQRERGGGPKKPWKCGDCGKAFSYCSAFILHQRIHTGEKPFACPECGKAFSQSVHLTLHQRTHTGEKPYACHECGKAFSQGSYLASHWRTHTGEKPHRCADCGKAFTRVTHLTQHRRVHTGERPYACAQCAKAFRNRSSLIEHQRIHTGEKPYECSACAKAFRFSSALIRHQRIHTEEKPYRCGQCAKAFAQIAHLTQHRRVHTGEKPYTCQDCGALFSQSASLAEHRRIHTGEKPYACGQCAKAFTQVSHLTQHQRTHTGERPYPCHDCGKRFSNRSHLLQHRLVHTGERPYRCLQCGAAFSHVSSLIEHQKIHTGERPYKCGECGKAFSQGSSLALHQRTHTGERPYTCPECGKAFSNRSYLIQHHIVHTGEKPYECSGCGKAFSFSSALIRHQRTHADSSGRLCPAPTPDSTPGLSQGGETCQQGCPGRNPRGPAED

SEQ ID NO: 17559 - protein, 813 aa, Homo sapiens
MLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGEGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 17560 - protein, 455 aa, Homo sapiens
MPADPCEGGARSCLVTESARGGLQFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMLKFPMGAMSYCLRDRSRFLFRLPMGLSCPLQVQ

SEQ ID NO: 17561 - protein, 927 aa, Homo sapiens
MADAEPEAGGGSEDGGGGGGPAPPGQSGSVARVAPLGPEQLRQVLEQVTKAQPPPPPPPFVLRDAARRLRDAAQQAALQRGRGTEPPRLPRLLPPQQLEAICVKVTSGETKGQERPMLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 17562 - protein, 811 aa, Homo sapiens
MLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 17563 - protein, 811 aa, Homo sapiens; identical to SEQ ID NO: 17562

SEQ ID NO: 17564 - protein, 348 aa, Homo sapiens
MRSLPFALTVESVSARAPTCCSTGRFTQGRQPCKCKACGRGFTQSASLLQHWRVHSDWRETLSLSPVRQDLLWPLQPHQAPASPLGRSHSSAGVRQGFSGQLCCWLTKEHTLAEALRLSPVPAGFWGPVEADRPPANSHRRVCPFCCCSCGDSVNEKTSLSQRVLPHPGEKTCRGGSVESVSLAPSSVAPDSTSGLRPCGSPGSFLQHLPPSTLLPRPPFLYPGPPLSLQPLVPSGLPAVPAVPLGGLEVAQVPPATQPAAQQEGAMGPRSCASAGRDSREAVQAPGYPEPARKASQHRAAGPLGEARARLQRQCRAPPPPSNPHWRGALPVFPVWKASSRRSNLARH

SEQ ID NO: 17565 - protein, 595 aa, Homo sapiens
MGPLTFRDVAIEFSLKEWQCLDTAQRNLYRNVMLENYRNLVFLGITVSKPDLITCLEQGKEAWSMKRHEIMVAKPTVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 17566 - protein, 1090 aa, Homo sapiens
MNMEGLVMFQDLSIDFSQEEWECLDAAQKDLYRDVMMENYSSLVSLGLSIPKPDVISLLEQGKEPWMVSRDVLGGWCRDSEFRCKTKDSCLPKEIYEVTSSQWVRMEKCHSLVGSSVRDDWECKGQFQHQDINQERYLEKAIMTYETTPTFCLQTSLTLHHRIHPGEKLYKSTECMAFKYGSELTQQQETHTGEKLYKCKECGKAFHHFSYLVKHQRIHTGEKPCACKEYGKAFISGSHLIQHQKMYTDERPHECQESVKAFRPSAHLIQHWRIHTGDKPYECKECGKSFTSGSTLNQHQQIHTGEKPYHCKQCGKSFTVGSTLIRHQQIHTGEKPYDCKECGKSFASGSALIRHQRIHTGEKPYDCKECGKSFTFHSALIRHQRIHTGEKPYDCKECGKSFTFRSGLIGHQAIHTGEKPYDCKECGKSFTAGSTLIQHQRIHTGEKPYDCKECGKSFASGSALLQHQRIHTGEKPYCCKECGKSFTFRSTRNRHQRIHTGEKPYNCKECGKSFASGSALLQHQRIHTGEKPYHCKECGKSFTFRSGLIGHQAVHTGEKPYDCKECGKSFTSRSALIQHQRIHTGEKPYHCKECGKSFTVGSTLLQHQQIHTGEKPYDCKECGKAFRLRLRLTQHQQIHTGEKPYQCQECGKAFVSVSGLTQHHRIHTGEKPYECPDCGKAFRQRTYLNQHRRIHTGEKPYECKECGKSFTFCSGLIQHQQNHTDEKPYDGKECGKSFTSHSTLIQHQQIHTGEKPYDCKECGKSFTSHSTLIQHQQIHTGEKLYDCKECGKSFTSHSTLIQHQPLHTGEKPYHCKECGKSFTLRSALIQHRPVHTGEKRYSCKECGKSFTSRSTLIEHQRIHTGEKPYHCKECGKSFAFRSAIIQHRRIHTGEKPYDCKECGKAFRRRSKLTQHQRIHTGEKPYRCHECGKAFVRFSGLTKHHSIHTGEKPYECKTCGKSFRQRTHLTLHQRIHTGDRPYECKECGKSFTCGSELIRHQRTHTGEKPYDCKECGKAFRCPSQLSQHKRIHTGEKTYQCPECGKAFFYASGLSRHQSVHTGEKPYECKTCGKAFKQLTQLTRHQRIHDLT

SEQ ID NO: 17567 - protein, 530 aa, Homo sapiens
MVRPQDTVAYEDLSEDYTQKKWKGLALSQRALHWNMMLENDRSMASLGRNMMESSELTPKQEIFKGSESSNSTSGGLFGVVPGGTETGDVCEDTFKELEGQPSNEEGSRLESDFLEIIDEDKKKSTKDRYEEYKEVEEHPPLSSSPVEHEGVLKGQKSYRCDECGKAFYWSSHLIGHRRIHTGEKPYECNECGKTFRQTSQLIVHLRTHTGEKPYECSECGKAYRHSSHLIQHQRLHNGEKPYKCNECAKAFNQSSKLFDHQRTHTGEKPYECKECGAAFSRSKNLVRHQFLHTGKKPYKCNECGRAFCSNRNLIDHQRTHTGEKPYKCNECGKAFSRSKCLIRHQSLHTGEKPYKCSECGKAFNQISQLVEHERIHTGEKPFKCSECGKAFGLSKCLIRHQRLHTSEKPYKCNECGKSFNQNSYLIIHQRIHTGEKPYECNECGKVFSYNSSLMVHQRTHTGEKPYKCNSCGKAFSDSSQLTVHQRVHTGEKPYECIECGKAFSQRSTFNHHQRTHAGEKPSGLARSSS

SEQ ID NO: 17568 - protein, 543 aa, Homo sapiens
MVRPQDTVAYEDLSEDYTQKKWKGLALSQRALHWNMMLENDRSMASLGRNMMESSELTPKQEIFKGSESSNSTSGGLFGVVPGGTETGDVCEDTFKELEGQPSNEEGSRLESDFLEIIDEDKKKSTKDRYEEYKEVEEHPPLSSSPVEHEGVLKGQKSYRCDECGKAFYWSSHLIGHRRIHTGEKPYECNECGKTFRQTSQLIVHLRTHTGEKPYECSECGKAYRHSSHLIQHQRLHNGEKPYKCNECAKAFNQSSKLFDHQRTHTGEKPYECKECGAAFSRSKNLVRHQFLHTGKKPYKCNECGRAFCSNRNLIDHQRTHTGEKPYKCNECGKAFSRSKCLIRHQSLHTGEKPYKCSECGKAFNQISQLVEHERIHTGEKPFKCSECGKAFGLSKCLIRHQRLHTSEKPYKCNECGKSFNQNSYLIIHQRIHTGEKPYECNECGKVFSYNSSLMVHQRTHTGEKPYKCNSCGKAFSDSSQLTVHQRVHTGEKNLMNVLSVGKPLVSVPLLITTSELMLERSPQVWLGHLLKAWFSETDSKDL

SEQ ID NO: 17569 - protein, 659 aa, Homo sapiens
MLHQPTPGNRGLTARMEVGPATETFVLELQCLEDGGPGPDTLSGGSGGSESQEEEEPQERNSSPQRPAVSAPVGASEIAEETRPGQRELQLQQLEQQPEPQQQPQHEQLQQPQPHLELQQQPQQDGQQQLSQLQQEKHQSVHHQELKPELQLMHQQQQLQPQQVQEQQRLQQQQEQLQTQQAQEQQVLQQQEQLQQQVQEQQLLQQQQEQLQQQQLLQQQEQLQQQQFQQQQEQLQQQQQLLLLQQQGQLQQQLLQQQQAQLQQQLLEQQQAQLQQQLLLQQQEQLQQQQQQQLLQQQQEQLQQQQLQPPPLEPEEEEEVELELMPVDLGSEQELEQQRQELERQQELERQQEQRQLQLKLQEELQQLEQQLEQQQQQLEQQEVQLELTPVELGAQQQEVQLELTPVQPELQLELVPAAGGGGAAVPGAPAAVVVAPPGYVVVQELMVLPAVAAPAVVAIPGPAGSAALTPARQRRRRRARDRPTICGECGKGFSRSTDLVRHQATHTGERPHRCGECGKGFSQHSNLVTHQRIHTGEKPYACSYCAKRFSESSALVQHQRTHTGERPYACGDCGKRFSVSSNLLRHRRTHSGERPYVCEDCGERFRHKVQIRRHERQLHGAGRSRGLGLLRASRPAALGGPARAEQAATATAPADKAL

SEQ ID NO: 17570 - protein, 1059 aa, Homo sapiens
MEANPAGSGAGGGGSSGIGGEDGVHFQSYPFDFLEFLNHQRFEPMELYGEHAKAVAALPCAPGPPPQPPPQPPPPQYDYPPQSTFKPKAEVPSSSSSSSSSSSSSSSSSSSSSSSSSQAKKPDPPLPPAFGAPPPPLFDAAFPTPQWGIVDLSGHQHLFGNLKRGGPASGPGVTPGLGAPAGAPGPLPAPSQTPPGPPAAAACDPTKDDKGYFRRLKYLMERRFPCGVCQKSFKQSSHLVQHMLVHSGERPYECGVCGRTYNHVSSLIRHRRCHKDVPPAAGGPPQPGPHLPPLGLPAPAASAATAAAPSTVSSGPPATPVAPAPSADGSAAPAGVGVPPPATGGGDGPFACPLCWKVFKKPSHLHQHQIIHTGEKPFSCSVCSKSFNRRESLKRHVKTHSADLLRLPCGICGKAFRDASYLLKHQAAHAGAGAGGPRPVYPCDLCGKSYSAPQSLLRHKAAHAPPAAAAEAPKDGAASAPQPPPTFPPGPYLLPPDPPTTDSEKAAAAAAAVVYGAVPVPLLGAHPLLLGGAGTSGAGGSGASVPGKTFCCGICGRGFGRRETLKRHERIHTGEKPHQCPVCGKRFRESFHLSKHHVVHTRERPYKCELCGKVFGYPQSLTRHRQVHRLQLPCALAGAAGLPSTQGTPGACGPGASGTSAGPTDGLSYACSDCGEHFPDLFHVMSHKEVHMAEKPYGCDACGKTFGFIENLMWHKLVHQAAPERLLPPAPGGLQPPDGSSGTDAASVLDNGLAGEVGAAVAALAGVSGGEDAGGAAVAGAGGGASSGPERFSCATCGQSFKHFLGLVTHKYVHLVRRTLGCGLCGQSFAGAYDLLLHRRSHRQKRGFRCPVCGKRFWEAALLMRHQRCHTEQRPYRCGVCGRGFLRSWYLRQHRVVHTGERAFKCGVCAKRFAQSSSLAEHRRLHAVARPQRCSACGKTFRYRSNLLEHQRLHLGERAYRCEHCGKGFFYLSSVLRHQRAHEPPRPELRCPACLKAFKDPGYFRKHLAAHQGGRPFRCSSCGEGFANTYGLKKHRLAHKAENLGGPGAGAGTLAGKDA

SEQ ID NO: 17571 - protein, 531 aa, Homo sapiens
MDSVAFEDVAVNFTQEEWALLDPSQKNLYREVMQETLRNLTSIGKKWNNQYIEDEHQNPRRNLRRLIGERLSESKESHQHGEVLTQVPDDTLKKKTPGVQSYESSVCGEIGIGLSSLNRHLRAFSYSSSLAIHGRTHTGEKPYECKECGKAFRFPSSVRRHERIHSAKKPYECKQCGKAFSFPSSVRRHERIHSAKKPYECKQCGKALSYLVSFQTHMRMHTGERPHKCNICGKAFFSPSSLKRHEKSHTGEKRYKCKQCDKAFNCPSSFQYHERTHSGEKPYECTQCRKAFRSVKYLRVHERKHTGEKPYECKLCGKGFISSTSFRYHEKTHTGEKPYECKKCVKAFSFVKDLRIHERTHTGEKPFECKQCGKTFTSSNSFHYHERTHTGEKPYECKQCGKAFRSASVLQKHIRTHTGEKPYGCKQCGKVFRVASQLKMHERTHTGEKPYECKQCGKAFISSNSIRYHKRTHTGEKPYKCKQCGKAFISSNSFLYHERIHTGEKPYECKQCGKAFRSASILQKHVRTHAG

SEQ ID NO: 17572 - protein, 98 aa, Homo sapiens
MLRRGHLAFRDVAIEFPQEEWKCLDPAQRTLYREVMVENYRNLVFLGICLPDLSVISMLEQRRDPRNLQSEVKIANNPGSCSVTQAVVEWQSSVAIVA

SEQ ID NO: 17573 - protein, 577 aa, Homo sapiens
MLRRGHLAFRDVAIEFPQEEWKCLDPAQRTLYREVMVENYRNLVFLGICLPDLSVISMLEQRRDPRNLQSEVKIANNPGGRECIKGVNAESSSKLGSNAGNKSLKNQLGLTFQLHLSELQLFQAERNISGCKHVEKPINNSLVSPLQKIYSSVKSHILNKYRNDFDDSPFLPQEQKAQIREKPCECNEHGKAFRVSSRLANNQVIHTADNPYKCNECDKVFSNSSNLVQHQRIHTGEKPYKCHECGKLFNRISLLARHQRIHTGEKPYKCHECGKVFTQNSHLANHHRIHTGEKPYKCNECGKVFNRNAHLARHQKIHSGEKPYKCKECGKAFSGGSGLTAHLVIHTGEKLYKCNKCGKVFNRNAHLTRHQRIHTGEKPYECKECGKVFRHKFCLTNHHRMHTGEQPYKCNECGKAFRDCSGLTAHLLIHTGEKPYKCKECAKVFRHRLSLSNHQRFHTGEKPYRCDECGKDFTRNSNLANHHRIHTGEKPYKCSECHKVFSHNSHLARHRQIHTGEKSYKCNECGKVFSHKLYLKKHERIHTGEKPYRCHECGKDFTRNSNLANHHRIHTGEKPYR

SEQ ID NO: 17574 - protein, 544 aa, Homo sapiens
MAVMDLSSPWALTKQDSACFHLRNAEEERMIAVFLTTWLQEPMTFKDVAVEFTQEEWMMLDSAQRSLYRDVMLENYRNLTSVEYQLYRLTVISPLDQEEIRNMKKRIPQAICPDQKIQPKTKESTVQKILWEEPSNAVKMIKLTMHNWSSTLREDWECHKIRKQHKIPGGHWRQMIYAPKKTVPQELFRDYHELEENSKLGSKLIFSQSIFTSKHCQKCYSEIGCLKHNSIINNYVKNSISEKLYESHECDTTLWHFQRNQTVQKEYTYSKHGMHFTHNMFPVPNNLHMAQNACECNKDETLCHQSSLKKQGQTHTEKKHECNQCGKAFKRISNLTLYKKSHMGEKQYECKECGKVFNDSSTLRRHVRTHTGEKPYECNQCGKAFSQKTSLKAHMRTHTGEKPYECNQCGKSFGTSSYLIVHKRIHTGEKLYECSECGKAFNTSSHLKVHKKIHTGENVYECSDCGKVFSGVSSLRMHIRTHTGEKPYECKECRKAFSVSSSLRRHVRIHTGEKPYECIQCGKAFSQSSSLIIHKRIHTERETL

SEQ ID NO: 17575 - protein, 939 aa, Homo sapiens
MATSQYFDFAQGGGPQYSAQPPTLPLPTVGASYTAQPTPGMDPAVNPAFPPAAPAGYGGYQPHSGQDFAYGSRPQEPVPTATTMATYQDSYSYGQSAAARSYEDRPYFQSAALQSGRMTAADSGQPGTQEACGQPSPHGSHSHAQPPQQAPIVESGQPASTLSSGYTYPTATGVQPESSASIVTSYPPPSYNPTCTAYTAPSYPNYDASVYSAASPFYPPAQPPPPPGPPQQLPPPPAPAGSGSSPRADSKPPLPSKLPRPKAGPRQLQLHYCDICKISCAGPQTYREHLGGQKHRKKEAAQKTGVQPNGSPRGVQAQLHCDLCAVSCTGADAYAAHIRGSKHQKVFKLHAKLGKPIPTLEPALATESPPGAEAKPTSPTGPSVCASSRPALAKRPVASKALCEGPPEPQAAGCRPQWGKPAQPKLEGPGAPTQGGSKEAPAGCSDAQPVGPEYVEEVFSDEGRVLRFHCKLCECSFNDLNAKDLHVRGRRHRLQYRKKVNPDLPIATEPSSRARKVLEERMRKQRHLAEERLEQLRRWHAERRRLEEEPPQDVPPHAPPDWAQPLLMGRPESPASAPLQPGRRPASSDDRHVMCKHATIYPTEQELLAVQRAVSHAERALKLVSDTLAEEDRGRREEEGDKRSSVAPQTRVLKGVMRVGILAKGLLLRGDRNVRLALLCSEKPTHSLLRRIAQQLPRQLQMVTEDEYEVSSDPEANIVISSCEEPRMQVTISVTSPLMREDPSTDPGVEEPQADAGDVLSPKKCLESLAALRHARWFQARASGLQPCVIVIRVLRDLCRRVPTWGALPAWAMELLVEKAVSSAAGPLGPGDAVRRVLECVATGTLLTDGPGLQDPCERDQTDALEPMTLQEREDVTASAQHALRMLAFRQTHKVLGMDLLPPRHRLGARFRKRQRGPGEGEEGAGEKKRGRRGGEGLV

SEQ ID NO: 17576 - protein, 366 aa, Homo sapiens
MATSQYFDFAQGGGPQYSAQPPTLPLPTVGASYTAQPTPGMDPAVNPAFPPAAPAGYGGYQPHSGQDFAYGSRPQEPVPTATTMATYQDSYSYGQSAAARSYEDRPYFQSAALQSGRMTAADSGQPGTQEACGQPSPHGSHSHAQPPQQAPIVESGQPASTLSSGYTYPTATGVQPESSASIVTSYPPPSYNPTCTAYTAPSYPNYDASVYSAASPFYPPAQPPPPPGPPQQLPPPPAPAGSGSSPRADSKPPLPSKLPRPKAGPRQLQLHYCDICKISCAGPQTYREHLGGQKHRKKEAAQKTGVQPNGSPRGVQAQLHCDLCAVSCTGADAYAAHIRGSKHQKGLLSHRQQAADPSGGNQPNLN

SEQ ID NO: 17577 - protein, 70 aa, Homo sapiens
MATSQYFDFAQGGGPQYSPEVETTPPALASGLPCALPWTVGCSGSDAVTALCPSLRGLACICSILWDPAW

SEQ ID NO: 17578 - protein, 280 aa, Homo sapiens
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQGMDRVQCSGDLQLAHQLQQEEDRKRRSEESRQEIEEFQKLQELLKHFIGIIRMLPQM

SEQ ID NO: 17579 - protein, 578 aa, Homo sapiens
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQGMDRVQCSGDLQLAHQLQQEEDRKRRSEESRQEIEEFQKLQRQYGLDNSGGYKQQQLRNMEIEVNRGRMPPSEFHRRKADMMESLALGFDDGKTKTSGIIEALHRYYQNAATDVRRVWLSSVVDHFHSSLGDKGWGCGYRNFQMLLSSLLQNDAYNDCLKGMLIPCIPKIQSMIEDAWKEGFDPQGASQLNNRLQGTKAWIGACEVYILLTSLRVKCHIVDFHKSTGPLGTHPRLFEWILNYYSSEGEGSPKVVCTSKPPIYLQHQGHSRTVIGIEEKKNRTLCLLILDPGCPSREMQKLLKQDIEASSLKQLRKSMGNLKHKQYQILAVEGALSLEEKLARRQASQVFTAEKIP

SEQ ID NO: 17580 - protein, 268 aa, Homo sapiens
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 17581 - protein, 53 aa, Homo sapiens
MAATQKLVKDIIDSKTGETASKRWKGAKNSETAAKVALMKLKMHADGDKSLPQ

SEQ ID NO: 17582 - protein, 43 aa, Homo sapiens
MAATQKLVKDIIDSKTGETASKRWKGAKNSETAAKVALMKLKM

SEQ ID NO: 17583 - protein, 42 aa, Homo sapiens
MAATQKLVKDIIDSKTGETASKRWKGAKNSETAAKVALMKLK

SEQ ID NO: 17584 - protein, 97 aa, Homo sapiens
MAATQKLVKDIIDSKTGETASKRWKGAKNSETAAKVALMKLKMHADGDKSLPQTERIYFQVFLPKGSKEKSKPMFFCHRWSIGKAIDFAASLARLKN

SEQ ID NO: 17585 - protein, 119 aa, Homo sapiens
MAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALP

SEQ ID NO: 17586 - protein, 161 aa, Homo sapiens
MAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 17587 - protein, 53 aa, Homo sapiens; identical to SEQ ID NO: 17581

SEQ ID NO: 17588 - protein, 161 aa, Homo sapiens; identical to SEQ ID NO: 17586

SEQ ID NO: 17589 - protein, 61 aa, Homo sapiens
MAATQKLVKDIIDSKTGETASKRWKGAKNSETAAKVALMKLKMHADGDKSLPQTERIYFQV

SEQ ID NO: 17590 - protein, 115 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRDLQIPR

SEQ ID NO: 17591 - protein, 727 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 17592 - protein, 653 aa, Homo sapiens
MELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 17593 - protein, 609 aa, Homo sapiens
MAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 17594 - protein, 224 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMRRMYYSSPPTCESPSSDKEENNKSLFSLWKENRTG

SEQ ID NO: 17595 - protein, 224 aa, Homo sapiens; identical to SEQ ID NO: 17594

SEQ ID NO: 17596 - protein, 208 aa, Homo sapiens
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 17597 - protein, 839 aa, Homo sapiens
MNRKDFVVLPWGKPGNSVKLKYRNAQELRMEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQKGALKLHRTTLLQAKSQILFNVLDVAHQFIKDVNPDEPKEENNSTKETSKIQHKPKSVLLQRSSSEVEITTMKRAQRTKPRKSLLCEGSFDEEASAQSFQEVLSQWRTGNHDDNKKQNLHAAVKDSLEECEVQTNLKIWREPLNIELKEDILSYMEKLWLKKHRRTPQEQLFKMLPDTFPHPHETTGDAQCSQNENDEDSDGEETKVQHTALLLPVETLNIERPEPSLKIVELDDTYEEEFEEAENIVPYKVKLADADSQRSCAFHDCQKNSFPYENGIHQHHVFDKGKRDFLNLCLRNSSTYYKDNSKAETSNTDFDNIVDPDVYSSDIEKIEESTSFERNLKEKNIGLESNQKSDDSCVSLESKDTLLGRDLEKAPIEEKLSQDIKESLELSNLYKRPSFEESKTTKSSLLLQEIACRSKPITKQYQGLERFFIFDTNERLNLLPSHRLECNNSSTRITLAEDREWIPDHSLSEYADNAIVLGVLQGAQSPSSSRKQQKMGQKSQRPSTANFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRDTKIQSLLSLSESSTDEEEEDFLNKQHVITLPWSKST

SEQ ID NO: 17598 - protein, 800 aa, Homo sapiens
MNRKDFVVLPWGKPGNSVKLKYRNAQELRMEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQKGALKLHRTTLLQAKSQILFNVLDVAHQFIKDVNPDEPKEENNSTKETSKIQHKPKSVLLQRSSSEVEITTMKRAQRTKPRKSLLCEGSFDEEASAQSFQEVLSQWRTGNHDDNKKQNLHAAVKDSLEECEVQTNLKIWREPLNIELKEDILSYMEKLWLKKHRRTPQEQLFKMLPDTFPHPHETTGDAQCSQNENDEDSDGEETKVQHTALLLPVETLNIERPEPSLKIVELDDTYEEEFEEAENIVPYKVKLADADSQRSCAFHDCQKNSFPYENGIHQHHVFDKGKRDFLNLCLRNSSTYYKDNSKAETSNTDFDNIVDPDVYSSDIEKIEESTSFERNLKEKNIGLESNQKSDDSCVSLESKDTLLGRDLEKAPIEEKLSQDIKESLELSNLYKRPSFEESKTTKSSLLLQEIACRSKPITKQYQGLERFFIFDTNERLNLLPSHRLECNNSSTRITLAGQKSQRPSTANFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRDTKIQSLLSLSESSTDEEEEDFLNKQHVITLPWSKST

SEQ ID NO: 17599 - protein, 800 aa, Homo sapiens; identical to SEQ ID NO: 17598

SEQ ID NO: 17600 - protein, 839 aa, Homo sapiens; identical to SEQ ID NO: 17597

SEQ ID NO: 17601 - protein, 163 aa, Homo sapiens
MNRKDFVVLPWGKPGNSVKLKYRNAQELRMEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQ

SEQ ID NO: 17602 - protein, 218 aa, Homo sapiens
MMRREDEEEEGTMMKAKGDLEMKEEEEISETGELVGPFVSAMPTPMPHNKGTRFSEAWEYFHLAPARAGHHPNQYATCRLCGRQVSRGPGVNVGTTALWKHLKSMHREELEKSGHGQAGQRQDPRPHGPQLPTGIEGNWGRLLEQVGTMALWASQREKEVLRRERAVEWRERAVEKRERALEEVERAILEMKWKVRAEKEACQREKELPAAVHPFHFV

SEQ ID NO: 17603 - protein, 234 aa, Homo sapiens
MRSGEPACTMDQARGLDDAAARGGQCPGLGPAPTPTPPGRLGAPYSEAWGYFHLAPGRPGHPSGHWATCRLCGEQVGRGPGFHAGTSALWRHLRSAHRRELESSGAGSSPPAAPCPPPPGPAAAPEGDWARLLEQMGALAVRGSRRERELERRELAVEQGERALERRRRALQEEERAAAQARRELQAEREALQARLRDVSRREGALGWAPAAPPPLKDDPEGDRDGCVITKVLL

SEQ ID NO: 17604 - protein, 150 aa, Homo sapiens
MRSGEPACTMDQARGLDDAAARGGQCPGLGPAPTPTPPGRLGAPYSEAWGYFHLAPGRPGHPSGHWATCRLCGEQVGRGPGFHAGTSALWRHLRSAHRRELESSGAGSSPPAAPCPPPPGPAAAPEGDWARLLEQMGALAVRGSRREREL

SEQ ID NO: 17605 - protein, 1989 aa, Homo sapiens
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGLQDKEQNLTRRISTSDILSEKKLGEDEEELSELQLRLLALQSASKKWQQKEQQVMKESKEKLTKTKTVQQKVKTSTKTHSAKKVSTTAKQALRKQQTKAWKKLQQQKEQERQKEEDQRKQAEEEERRKREEEIRKIRDLSNQEEQYNRFMKLVGGKRRSRSKSSDPDLRRSLDKQPTDSGGGIYQYDNYEEVAMDTDSETSSPAPSPVQPPFFSECSLGYFSPAPSLSLPPPPQVSSLPPLSQPYVEGLCVSLEPLPPLPPLPPLPPEDPEQPPKPPFADEEEEEEMLLREELLKSLANKRAFKPEETSSNSDPPSPPVLNNSHPVPRSNLSIVSINTVSQPRIQNPKFHRGPRLPRTVISLPKHKSVVVTLNDSDDSESDGEASKSTNSVFGGLESMIKEARRTAEQASKPKVPPKSEKENDPLRTPEALPEEKKIEYRLLKEEIANREKQRLIKSDQLKTSSSSPANSDVEIDGIGRIAMVTKQVTDAESKLKKHRILLMKDESVLKNLVQQEAKKKESVRNAEAKITKLTEQLQATEKILNVNRMFLKKLQEQIHRVQQRVTIKKALTLKYGEELARAKAVASKEIGKRKLEQDRFGPNKMMRLDSSPVSSPRKHSAELIAMEKRRLQKLEYEYALKIQKLKEARALKAKEQQNISPVVEEEPEFSLPQPSLHDLTQDKLTLDTEENDVDDEILSGSSRERRRSFLESNYFTKPNLKHTDTANKECINKLNKNTVEKPELFLGLKIGELQKLYSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEKNPQNAEVFYHMCKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKIWMDYLVFANNRAAGSRNKVQEFKFFTDLVNRCLVTVPARYPIPFSSADYWSNYEFHNRVIFFYLSCVPKTQHSKTLERFCSVMPANSGLALRLLQHEWEESNVQILKLQAKMFTYNIPTCLATWKIAIAAEIVLKGQREVHRLYQRALQKLPLCASLWKDQLLFEASEGGKTDNLRKLVSKCQEIGVSLNELLNLNSNKTESKNH

SEQ ID NO: 17606 - protein, 346 aa, Homo sapiens
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGNGIKYFS

SEQ ID NO: 17607 - protein, 201 aa, Homo sapiens
MEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 17608 - protein, 224 aa, Homo sapiens
MADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 17609 - protein, 176 aa, Homo sapiens
MADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLEPACHVTSKFTGMHLYALFARPRVGPGTPKSRNGSRMNKEREST

SEQ ID NO: 17610 - protein, 219 aa, Homo sapiens
MIHFHLIFLYVARNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 17611 - protein, 170 aa, Homo sapiens
MATPMHRLIARRQAEANKQHVRCQKCLEFGHWTYECTGKRKYLHRPSRTAELKKALKEKENRLLLQQSIGETNVERKAKKKRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 17612 - protein, 166 aa, Homo sapiens
MSSKDFFACGHSGHWARGCPRGGAGGRRGGGHGRGSQCGSTTLSYTCYCCGESGRNAKNCVLLGNICYNCGRSGHIAKDCKDPKRERRQHCYTCGRLGHLARDCDRQKEQKCYSCGKLGHIQKDCAQVKCYRCGEIGHVAINCSKARPGQLLPLRQIPTSSQGMSQ

SEQ ID NO: 17613 - protein, 949 aa, Homo sapiens
MASNHPAFSFHQKQVLRQELTQIQSSLNGGGGHGGKGAPGPGGALPTCPACHKITPRTEAPVSSVSNSLENALHTSAHSTEESLPKRPLGKHSKVSVEKIDLKGLSHTKNDRNVECSFEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRTQMDTSPAILMPSSLQTPQTQEQNGILDWLRKLRLHKYYPVFKQLSMEKFLSLTEEDLNKFESLTMGAKKKLKTQLELEKEKSERRCLNPSAPPLVTSSGVARVPPTSHVGPVQSGRGSHAAELRVEVEQPHHQLPREGSSSEYSSSSSSPMGVQAREESSDSAEENDRRVEIHLESSDKEKPVMLLNHFTSSSARPTAQVLPVQNEASSNPSGHHPLPPQMLSAASHITPIRMLNSVHKPERGSADMKLLSSSVHSLLSLEERNKGSGPRSSMKVDKSFGSAMMDVLPASAPHQPVQVLSGLSESSSMSPTVSFGPRTKVVHASTLDRVLKTAQQPALVVETSTAATGTPSTVLHAARPPIKLLLSSSVPADSAISGQTSCPNNVQISVPPAIINPRTALYTANTKVAFSAMSSMPVGPLQGGFCANSNTASPSSHPSTSFANMATLPSCPAPSSSPALSSVPESSFYSSSGGGGSTGNIPASNPNHHHHHHHQQPPAPPQPAPPPPGCIVCTSCGCSGSCGSSGLTVSYANYFQHPFSGPSVFTFPFLPFSPMCSSGYVSAQQYGGGSTFPVVHAPYSSSGTPDPVLSGQSTFAVPPMQNFMAGTAGVYQTQGLVGSSNGSSHKKSGNLSCYNCGATGHRAQDCKQPSMDFNRPGTFRLKYAPPAESLDSTD

SEQ ID NO: 17614 - protein, 310 aa, Homo sapiens
MEKCTKSSSTMQVEPSFLQAENLILRLQMQHPTTENTAKRGQVMPALATTVMPVPYSLEHLTQFHGDPANCSEFLTQVTTYLTALQISNPANDAQIKLFFDYLSQQLESCGIISGPDKSTLLKQYENLILEFQQSFGKPTKQEINPLMNAKFDKGDNSSQQDPATFHLLAQNLICNETNQSGQFEKALADPNQDEESVTDMMDNLPDLITQCIQLDKKHSDRPELLQSETQLPLLASLIQHQALFSPTDPPPKKGPIQLREGQLPLTPAKRARQQETQLCLYCSQSGHFTRDCLAKRSRAPATTNNTAHQ

SEQ ID NO: 17615 - protein, 228 aa, Homo sapiens
MQEVCSGEDTHGGHFPSRPGHTGAEQQCVQGRLTLWLPQQHRRWPQLPHRALLRPDPHLRGSQAQQAAPTQLPVPPVLQQRTLHQGLPPGTPQRRGPDSIPGQKALLRRVQVSQVQEKMDERELLGQHGAGVHQVPHQRVSTQAETPGEARRPGRVRPEQGAPAAPLREVQGPGLLLPSRAVTGCPPAPRATPRQPEETLLPCATPRGCVSPCAWGALAGLRGWAGGS

SEQ ID NO: 17616 - protein, 241 aa, Homo sapiens
MSLLSAIDTSAASVYQPAQLLNWVYLSLQDTHQASAFDAFRPEPTAGAAPPELAFGKGRPEQLGSPLHSSYLNSFFQLQRGEALSNSVYKGASPYGSLNNIADGLSSLTEHFSDLTLTSEARKPSKRPPPNYLCHLCFNKGHYIKDCPQARPKGEGLTPYQGKKRCFGEYKCPKCKRKWMSGNSWANMGQECIKCHINVYPHKQRPLEKPDGLDVSDQSKEHPQHLCEKCKVLGYYCRRVQ

SEQ ID NO: 17617 - protein, 404 aa, Homo sapiens
MATGGGAEEERKRGRPQLLPPARPAARGEEADGGREKMGWAQVVKNLAEKKGEFREPRPPRREEESGGGGGSAGLGGPAGLAAPDLGDFPPAGRGDPKGRRRDPAGEAVDPRKKKGAAEAGRRKKAEAAAAAMATPARPGEAEDAAERPLQDEPAAAAAGPGKGRFLVRICFQGDEGACPTRDFVVGALILRSIGMDPSDIYAVIQIPGSREFDVSFRSAEKLALFLRVYEEKREQEDCWENFVVLGRSKSSLKTLFILFRNETVDVEDIVTWLKRHCDVLAVPVKVTDRFGIWTGEYKCEIELRQGEGGVRHLPGAFFLGAERGYSWYKGQPKTCFKCGSRTHMSGSCTQDRCFRCGEEGHLSPYCRKGIVCNLCGKRGHAFAQCPKAVHNSVAAQLTGVAGH

SEQ ID NO: 17618 - protein, 475 aa, Homo sapiens
MVEDLAASYIVLKLENEIRQAQVQWLMEENAALQAQIPELQKSQAAKEYDLLRKSSEAKEPQKLPEHMNPPAAWEAQKTPEFKEPQKPPEPQDLLPWEPPAAWELQEAPAAPESLAPPATRESQKPPMAHEIPTVLEGQGPANTQDATIAQEPKNSEPQDPPNIEKPQEAPEYQETAAQLEFLELPPPQEPLEPSNAQEFLELSAAQESLEGLIVVETSAASEFPQAPIGLEATDFPLQYTLTFSGDSQKLPEFLVQLYSYMRVRGHLYPTEAALVSFVGNCFSGRAGWWFQLLLDIQSPLLEQCESFIPVLQDTFDNPENMKDANQCIHQLCQGEGHVATHFHLIAQELNWDESTLWIQFQEGLASSIQDELSHTSPATNLSDLITQCISLEEKPDPNPLGKSSSAEGDGPESPPAENQPMQAAINCPHISEAEWVRWHKGRLCLYCGYPGHFARDCPVKPHQALQAGNIQACQ

SEQ ID NO: 17619 - protein, 784 aa, Homo sapiens
MGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 17620 - protein, 168 aa, Homo sapiens
MEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPGIF

SEQ ID NO: 17621 - protein, 124 aa, Homo sapiens
MSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWV

SEQ ID NO: 17622 - protein, 395 aa, Homo sapiens
MTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 17623 - protein, 1259 aa, Homo sapiens
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHKDLTSLETTSEMEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPDCSLRLYGSSCSRLGFKNSDVNIDIQFPAIIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 17624 - protein, 1457 aa, Homo sapiens
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHKDLTSLETTSEMEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPDCSLRLYGSSCSRLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 17625 - protein, 1495 aa, Homo sapiens
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHKDLTSLETTSEMEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPDCSLRLYGSSCSRLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 17626 - protein, 165 aa, Homo sapiens
MEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLP

SEQ ID NO: 17627 - protein, 205 aa, Homo sapiens
MFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGQE

SEQ ID NO: 17628 - protein, 543 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 17629 - protein, 253 aa, Homo sapiens
MLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 17630 - protein, 707 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPKYHQVFSHIVSLEGQEIQVKAKRPKPHCFNCGSEEHQMKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTPPLPRGTPPPVFTPPLPKGTPPLTPSDSPQTRTASGAVDEDALTLEELEEQQRRIWAALEQAESVNSDSDVPVDTPLTGNSVASSPCPNELDLPVPEGKTSEKQTLDEPEVPEIFTKKSEAGHASSPDSEVTSLCQKEKAELAPVNTEGALLDNGSVVPNCDISNGGSQKLFPADTSPSTATKIHSPIPDMSKFATGITPFEFENMAESTGMYLRIRSLLKNSPRNQQKNKKASE

SEQ ID NO: 17631 - protein, 469 aa, Homo sapiens
MKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTPPLPRGTPPPVFTPPLPKGTPPLTPSDSPQTRTASGAVDEDALTLEELEEQQRRIWAALEQAESVNSDSDVPVDTPLTGNSVASSPCPNELDLPVPEGKTSEKQTLDEPEVPEIFTKKSEAGHASSPDSEVTSLCQKEKAELAPVNTEGALLDNGSVVPNCDISNGGSQKLFPADTSPSTATKIHSPIPDMSKFATGITPFEFENMAESTGMYLRIRSLLKNSPRNQQKNKKASE

SEQ ID NO: 17632 - protein, 38 aa, Homo sapiens
MKDCPMPRNAARISEKRKEYMDACGEANNQNFQQRYHA

SEQ ID NO: 17633 - protein, 469 aa, Homo sapiens; identical to SEQ ID NO: 17631

SEQ ID NO: 17634 - protein, 271 aa, Homo sapiens
MTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMVCFHCRKPGHGIADCPAALENQDMGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 17635 - protein, 271 aa, Homo sapiens; identical to SEQ ID NO: 17634

SEQ ID NO: 17636 - protein, 271 aa, Homo sapiens; identical to SEQ ID NO: 17634

SEQ ID NO: 17637 - protein, 271 aa, Homo sapiens; identical to SEQ ID NO: 17634

SEQ ID NO: 17638 - protein, 477 aa, Homo sapiens
MGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 17639 - protein, 469 aa, Homo sapiens
MMTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGGMGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTADVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLENGKERRPREFRF

SEQ ID NO: 17640 - protein, 648 aa, Homo sapiens
MMTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANGEEVPHTQEISVSWEGEAAPEIRTSKLGQPDPAPSKKKSNRLTLSKRKKEAHEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGLGGDAGTADGRGRTLQRKIMKRSLGRKSTAPPAPRMGRKEGQGNSDSDQPGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 17641 - protein, 356 aa, Homo sapiens
MDKEKLDVKIEYCNYAMDSSVENMYVNKVWVQCENENCLKWRLLSSEDSAKVDHDEPWYCFMNTDSRYNNCSISEEDFPEESQLHQCGFKIVYSQLPLGSLVLVKLQNWPSWPGILCPDRFKGKYVTYDPDGNVEEYHIEFLGDPHSRSWIKATFVGHYSITLKPEKCKNKKKWYKSALQEACLLYGYSHEQRLEMCCLSKLQDKSETHDKVAALVKKRKQTSKNNIEKKKPKFRKRKRKAILKCSFENVYSDDALSKENRVVCETEVLLKELEQMLQQALQPTATPDESEEGHGEEINMGEKLSKCSPEAPAGSLFENHYEEDYLVIDGIKLKAGECIEDITNKFKEIDALMSEF

SEQ ID NO: 17642 - protein, 127 aa, Homo sapiens
MDKEKLDVKIEYCNYAMDSSVENMYVNKVWVQCENENCLKWRLLSSEDSAKVDHDEPWYCFMNTDSRYNNCSISEEDFPEESQLHQCGFKIVYSQLPLGSLVLVKLQNWPSWPGILCPDRFKGKYVT

SEQ ID NO: 17643 - protein, 356 aa, Homo sapiens; identical to SEQ ID NO: 17641

SEQ ID NO: 17644 - protein, 2354 aa, Homo sapiens
MQKRQGYCSYCRVQYNNLEQHLFSAQHRSLTRQSRRQICTSSLMERFLQDVLQHHPYHCQESSSTQDETHVNTGSSSEVVHLDDAFSEEEEEDEDKVEDEDATEERPSEVSEPIEELHSRPHKSQEGTQEVSVRPSVIQKLEKGQQQPLEFVHKIGASVRKCNLVDIGQATNNRSNLVRPPVICNAPASCLPESSNDRPVTANTTSLPPAAHLDSVSKCDPNKVEKYLEQPDGASRNPVPSSHVETTSFSYQKHKESNRKSLRMNSDKLVLWKDVKSQGKTLSAGLKFHERMGTKGSLRVKSPSKLAVNPNKTDMPSNKGIFEDTIAKNHEEFFSNMDCTQEEKHLVFNKTAFWEQKCSVSSEMKFDCISLQSASDQPQETAQDLSLWKEEQIDQEDNYESRGSEMSFDCSSSFHSLTDQSKVSAKEVNLSKEVRTDVQYKNNKSYVSKISSDCDDILHLVTNQSQMIVKEISLQNARHISLVDQSYESSSSETNFDCDASPQSTSDYPQQSVTEVNLPKEVHIGLVDKNYGSSSSEVSADSVFPLQSVVDRPPVAVTETKLRKKAHTSLVDNYGSSCSETSFDCDVSLESVVDHPQLTVKGRNLKGRQVHLKHKKRKPSSAKAHLDCDVSLGTVADESQRAVEKINLLKEKNADLMDMNCESHGPEMGFQADAQLADQSQVAEIERQKVDVDLENKSVQSSRSSLSSDSPASLYHSAHDEPQEALDEVNLKELNIDMEVRSYDCSSSELTFDSDPPLLSVTEQSHLDAEGKERHIDLEDESCESDSSEITFDSDIPLYSVIDQPEVAVYEEETVDLESKSNESCVSEITFDSDIPLHSGNDHPEVAVKEVIQKEEYIHLERKNDEPSGSEISSDSHAPLHSVTNSPEVAVKKLNPQKEEQVHLENKENEPIDSEVSLDYNIIFHSVTGRSEDPIKEISLHTKEHMYLENKSVFETSLDSDVPLQAATHKPEVIVKETWLQREKHAEFQGRSTEFSGSKTSLDSGVPHYSVTEPQVAVNKINRKKQYVLENKNDKCSGSEIILDSNVPPQSMTDQPQLAFLKEKHVNLKDKNSKSGDSKITFDSEQLQEAVKKIDQWKEEVIGLKNKINEPSTYKLIHHPDVSVQSVADQPKVAIKHVNLGNENHMYLEVKNSQYSCSEMNLDSGFLGQSIVNRPQITILEQEHIELEGKHNQCCGSEVSFDSDDPLQSVADRLRETVKEISLWKDEEVDTEDRRNEAKGFEIMYDSDVLQPVAGQPEEVVKEVSLWKEHVDLENKIVKPTDSRINFDSHEPLQSVTNKIPGANKEINLLREEHVCLDDKGYVPSDSEIIYVSNIPLQSVIKQPHILEEEHASLEDKSSNSYSPEESSDSNDSFQAAADELQKPVKEINLWKEDHIYLEDKSYKLGDFDVSYASHIPVQFVTDQSSVPVKEINLQKKDHNDLENKNCEVCGSEIKCHSCVHLQSEVDQPQVSYKEADLQKEEHVVMEEKTDQPSDSEMMYDSDVPFQIVVNQFPGSVKETHLPKVVLVDLVPGDSDYEVISDDIPLQLVTDPPQLTVKDISCINTECIDIEDKSCDFFGSEVRCNCKASTPSMTNQCKETFKIINRKKDYIILGEPSCQSCGSEMNFNVDASDQSMTYESQGPDEKMVKYIDSEDKSCGYNGSKGKFNLEDTSHRTTHRLQKAHKEASLRKDPRNAGLKGKSCQSSASAVDFGASSKSALHRRADKKKRSKLKHRDLEVSCEPDGFEMNFQCAPPLPSDTDQPQETVKKRHPCKKVSSDLKEKNHDSQSSSVLKVDSVRNLKKAKDVIEDNPDEPVLEALPHVPPSFVGKTWSQIMREDDIKINALVKEFREGRFHCYFDDDCETKKVSSKGKKKVTWADLQGKEDTAPTQAVSESDDIVCGISDIDDLSVALDKPCHRHPPAERPPKQKGRVASQCQTAKISHSTQTSCKNYPVMKRKIIRQEEDPPKSKCSRLQDDRKTKKKVKIGTVEFPASCTKVLKPMQPKALVCVLSSLNIKLKEGEGLPFPKMRHHSWDNDIRFICKYKRNIFDYYEPLIKQIVISPPLSVIVPEFERRNWVKIHFNRSNQNSSAGDNDADGQGSASAPLMAVPARYGFNSHQGTSDSSLFLEESKVLHARELPKKRNFQLTFLNHDVVKISPKSVRNKLLESQSKKKIHGKRVTTSSNKLGFPKKVYKPIILQQKPRKASEKQSIWIRTKPSDIIRKYISKYSVFLRHRYQSRSAFLGRYLKKKKSVVSRLKKAKRTAKVLLNSSVPPAGAEELSSAMANPPPKRPVRASCRVARRRKKTDESYHGRQKGPSTPVRAYDLRSSSCLQQRERMMTRLANKLRGNEVK

SEQ ID NO: 17645 - protein, 371 aa, Homo sapiens
MDTRSGSQCSVTPEAIRNNEELVLPPRISRVNGWSLPLHYFRVVTWAVFVGLSLATFRIFIPLLPHSWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPRVLRTDPRYEDVKNMNTWLLFLPLFPVQVQTLIVVIIRMLVLLLDLLGLVQLGQLLIFHIYLKAKKMTTFEYLINTRKEESSKHQAVRKDPYVQMDKGFLQQGAGALGSSAQGVKAKSSLLIYKCPCHFCTSVNQDGDSKAQEADDAPSTSTLGLQQETTEPMKTDSAESED

SEQ ID NO: 17646 - protein, 403 aa, Homo sapiens
MNYDSQQPPLPPLPYAGCRRASGFPALGRGGTVPVGVWGGAGQGREGRSWGEGPRGPGLGRRDLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 17647 - protein, 461 aa, Homo sapiens
MPAVAEALGQEGPPDLSRSAFLATVLTSLSAAFSSMPSSAYSLPFSRSLELDYHTSSCFRGTMVKADCPVPITDLPDSSGKLQYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 17648 - protein, 471 aa, Homo sapiens
MNYDSQQPPLPPLPYAGCRRASGFPALGRGGTVPVGVWGGAGQGREGRSWGEGPRGPGLGRRDLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 17649 - protein, 154 aa, Homo sapiens
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 17650 - protein, 470 aa, Homo sapiens
MEFAAENEGKSGGGLHSVAEGVRLSPEPGREGVRDLAGAEEFGGGEEGTGLTGIKEIGDGEEGSGQRPEEIPMDLTVVKQEIIDWPGTEGRLAGQWVEQEVEDRPEVKDENAGVLEVKQETDSSLVVKEAKVGEPEVKEEKVKEEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCNGVRDKTAYISIQQFTEMNLLSDYRFLEDVARTADHISRDAFLKRPISNKYMYFMKNRARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVRYYELDPYKSLLDNLRNKVIIEYPTLHVVLKGSNNDMKVLHQVKSESTKNVGNEN

SEQ ID NO: 17651 - protein, 431 aa, Homo sapiens
MEFAAENEGKSGGGLHSVAEGVRLSPEPGREGVRDLAGAEEFGGGEEGTGLTGIKEIGDGEEGSGQRPEEIPMDLTVVKQETDSSLVVKEAKVGEPEVKEEKVKEEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCNGVRDKTAYISIQQFTEMNLLSDYRFLEDVARTADHISRDAFLKRPISNKYMYFMKNRARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVRYYELDPYKSLLDNLRNKVIIEYPTLHVVLKGSNNDMKVLHQVKSESTKNVGNEN

SEQ ID NO: 17652 - protein, 1548 aa, Homo sapiens
MAEREVESGPRKRFEQKSGAVFDEIVENCGGIMDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 17653 - protein, 1459 aa, Homo sapiens
MAEREVESGPRKRFEQKSGAVFDEIVENCGGIMDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 17654 - protein, 98 aa, Homo sapiens
MDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQI

SEQ ID NO: 17655 - protein, 1207 aa, Homo sapiens
  MOD_RES (1)..(1): Any amino acid
XPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 17656 - protein, 365 aa, Homo sapiens
MNVIYPLAVPKGRRLCCEVCEAPAERVCAACTVTYYCGVVHQKADWDSIHEKICQLLIPLRTSMPFYNSEEERQHGLQQLQQRQKYLIEFCYTIAQKYLFEGKHEDAVPAALQSLRFRVKLYGLSSVELVPAYLLLAEASLGLGRIVQAEEYLFQAQWTVLKSTDCSNATHSLLHRNLGLLYIAKKNYEEARYHLANDIYFASCAFGTEDIRTSGGYFHLANIFYDLKKLDLADTLYTKVSEIWHAYLNNHYQVLSQAHIQQMDLLGKLFENDTGLDEAQEAEAIRILTSILNIRESTSDKAPQKTIFVLKILVMFYYLMMNSSKAQEYGMRALSLAKEQQLDVHEQSTIQELLSLISTEDHPIT

SEQ ID NO: 17657 - protein, 255 aa, Homo sapiens
MSALDSTAHFHALLQFRGRTAAWPAAAAAAAGLGRIVQAEEYLFQAQWTVLKSTDCSNATHSLLHRNLGLLYIAKKNYEEARYHLANDIYFASCAFGTEDIRTSGGYFHLANIFYDLKKLDLADTLYTKVSEIWHAYLNNHYQVLSQAHIQQMDLLGKLFENDTGLDEAQEAEAIRILTSILNIRESTSDKAPQKTIFVLKILVMFYYLMMNSSKAQEYGMRALSLAKEQQLDVHEQSTIQELLSLISTEDHPIT

SEQ ID NO: 17658 - protein, 460 aa, Homo sapiens
MAPRSRRRRHKKPPSSVAPIIMAPTTIVTPVPLTPSKPGPSIDTLGFFSLDDNVPGLSQLILQKLNMKSYEEYKLVVDGGTPVSGFGFRCPQEMFQRMEDTFRFCAHCRALPSGLSDSKVLRHCKRCRNVYYCGPECQKSDWPAHRRVCQELRLVAVDRLMEWLLVTGDFVLPSGPWPWPPEAVQDWDSWFSMKGLHLDATLDAVLVSHAVTTLWASVGRPRPDPDVLQGSLKRLLTDVLSRPLTLGLGLRALGIDVRRTGGSTVHVVGASHVETFLTRPGDYDELGYMFPGHLGLRVVMVGVDVATGFSQSTSTSPLEPGTIQLSAHRGLYHDFWEEQVETGQTHHPDLVAAFHPGFHSSPDLMEAWLPTLLLLRDYKIPTLITVYSHQELVSSLQILVELDTHITAFGSNPFMSLKPEQVYSSPNKQPVYCSAYYIMFLGSSCQLDNRQLEEKVDGGI

SEQ ID NO: 17659 - protein, 460 aa, Homo sapiens; identical to SEQ ID NO: 17658

SEQ ID NO: 17660 - protein, 1079 aa, Homo sapiens
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 17661 - protein, 598 aa, Homo sapiens
MTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKKKLHESHKVTGAEQGLQVSGLPDSAAPEGGAAHTNDQRRCQRMKQPLTEVQILSHSS

SEQ ID NO: 17662 - protein, 368 aa, Homo sapiens
MGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQDLYDKVAWGKRTLVSGLFMECFCFVP

SEQ ID NO: 17663 - protein, 1077 aa, Homo sapiens
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 17664 - protein, 598 aa, Homo sapiens
MTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLETSKLHESHKVTGAEQGLQVSGLPDSAAPEGGAAHTNDQRRCQRMKQPLTEVQILSHSS

SEQ ID NO: 17665 - protein, 1077 aa, Homo sapiens
MPRVHNIKKSLTPHISCVTNESDNLLDFLPDRLRAKLLPFQKDGIIFALKRNGSRIDCDQMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 17666 - protein, 597 aa, Homo sapiens
MTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKKLHESHKVTGAEQGLQVSGLPDSAAPEGGAAHTNDQRRCQRMKQPLTEVQILSHSS

SEQ ID NO: 17667 - protein, 633 aa, Homo sapiens
MLRRGYKASERRRHLSERLSWHQDQALSSSIYLLREMGPTGFLLREEEPEYMDFRVFLGNPHVCNCSTFPKGGELCKHICWVLLKKFKLPRNHESALQLGLGEREISDLLRGIHRVQTPQPGTNDENEHVEEDGYIKQKEIDSEDICSICQELLLEKKLPVTFCRFGCGNSIHIKCMKILANYQSTSNTSMLKCPLCRKEFAPLKLILEEFKNSSKLVAAAEKERLDKHLGIPCNNCKQFPIEGKCYKCTECIEYHLCQECFDSCCHLSHTFTFREKRNQKWRSLEKRADEVVKYIDTKNEIEEKMSHFQEKQGQVYTPKHIVRSLPLQLITKNSKLLAPGYQCLLCLKAFHLGQHTRLLPCTHKFHRKCIDNWLFHKCNSCPIDGQVIYNPLTWKNSAVNGQAHQSVSNRDIIHLSKQKEPDLFIPGTGLVLKQNRLGILPSIPQCNFDELNTPQSPKDAYENTTIDNLCSIKLDNSNSKKLTYDYKISQHFPRYLQDLPTVSFGKIPSQTLLPPIVHKNIVCPTAMESPCISGKFHTSLSRMTKGCKCNNHNLKKTPATKIREDNKRSTLLPEDFNLIVNWSTAKLSLSKRYSNCMGEITRKCSHLSRQPVSHSVNTKSTELSLIIEGVQL

SEQ ID NO: 17668 - protein, 696 aa, Homo sapiens
MELGSCFKTYEDFKECFSAYKRENRCSFILRDCVSVRFHNLNHGTSIREDILYVQVKFVCIRTQSNRKRTREADMCPAYLLLRYNERLDRLFISELNTQHIHGDSKVASPGGDTTGKSQKTMCLQRLQPVQPTTKKDLDTAEKSLVEPSFCLDKVQVSSKPEQEGITPSDLAKIAKVMKNFLKVDEGSMASFSVGDSQHLDRLSFQSSKMTDLFIRFPENLLLHRVENTQGHILYAFLVENKERESRVVHFAVLKAETVTSVAKMLSIFTEFNSDWPKVKVVFVDPSFHYRAILQEIFPAARILLSIYHTTRLLEKKLHRSSANPSFKRLMKEALREAVFVTSEASLKNLCQMSQAVLDEDLFNFLQAHWFTCELLWYMHVRKGLLACNTYMDSLDIVTSKVSSLFREQQSLLDCILCFVDYIDFFNTKGLKNLPTPPPKLKRARPASMPLKSKKAFGICGESLTSLPAEETKPDAQQVQVQQQSQVPPSQVGMLDTLHQSGSELAYKLCHNEWEVVQNSTHLVDMAGSSVDVQLLEDSHQVSKDGCSCSCSFQQWYHLPCRHILALLHTSQQPVGEAMVCRRWQKKYQYLLGPNGELQDRGMVPNTGQPEKQGRNDMIQDLSRELANLLMQTEGPELEERYSTLRKIVDIWAGPSQPSELFQQPGDFKDVGRLPFLWGKQEEGEGFPPATAVMHY

SEQ ID NO: 17669 - protein, 690 aa, Homo sapiens
MKTRLERQAETTSGHPSLASLYYWTAPALPGPELEMAPPPHCAHNRYVQVKFVCIRTQSNRKRTREADMCPAYLLLRYNERLDRLFISELNTQHIHGDSKVASPGGDTTGKSQKTMCLQRLQPVQPTTKKDLDTAEKSLVEPSFCLDKVQVSSKPEQEGITPSDLAKIAKVMKNFLKVDEGSMASFSVGDSQHLDRLSFQSSKMTDLFIRFPENLLLHRVENTQGHILYAFLVENKERESRVVHFAVLKAETVTSVAKMLSIFTEFNSDWPKVKVVFVDPSFHYRAILQEIFPAARILLSIYHTTRLLEKKLHRSSANPSFKRLMKEALREAVFVTSEASLKNLCQMSQAVLDEDLFNFLQAHWFTCELLWYMHVRKGLLACNTYMDSLDIVTSKVSSLFREQQSLLDCILCFVDYIDFFNTKGLKNLPTPPPKLKRARPASMPLKSKKAFGICGESLTSLPAEETKPDAQQVQVQQQSQVPPSQVGMLDTLHQSGSELAYKLCHNEWEVVQNSTHLVDMAGSSVDVQLLEDSHQVSKDGCSCSCSFQQWYHLPCRHILALLHTSQQPVGEAMVCRRWQKKYQYLLGPNGELQDRGMVPNTGQPEKQGRNDMIQDLSRELANLLMQTEGPELEERYSTLRKIVDIWAGPSQPSELFQQPGDFKDVGRLPFLWGKQEEGEGFPPATAVMHY

SEQ ID NO: 17670 - protein, 989 aa, Homo sapiens
MEPPAAKRSRGCPAGPEERDAGAGAARGRGRPEALLDLSAKRVAESWAFEQVEERFSRVPEPVQKRIVFWSFPRSEREICMYSSLGYPPPEGEHDARVPFTRGLHLLQSGAVDRVLQVGFHLSGNIREPGSPGEPERLYHVSISFDRCKITSVSCGCDNRDLFYCAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 17671 - protein, 823 aa, Homo sapiens
MFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPGSEEEEEVAATSPRHTVFGRALLAGELHWNDAYLQRILASDSYGPSLTGSVGGDKPTFDPQGRPLWLGEPFPTACARVDTLRAHGYPRQALRLASAIINTLRLQQRHQLESYKQQKKELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 17672 - protein, 1185 aa, Homo sapiens
MADGGEREELLSPSPVSPAKRQCSWPSPQAHHPRGSPGAAGGGAGGVGSSCLVLGARPHLQPDSLLDCAAKTVAEKWAYERVEERFERIPEPVQRRIVYWSFPRNEREICMYSSFQYRGGPGAGAAGGAAGASPAEEGPQPPPGAAAPAGSAPGGVAAGASPGLGAGAGAAGCGGEGLPFRRGIRLLDSGSVENVLQVGFHLSGTVTELATASEPAVTYKVAISFDRCKITSVTCGCGNKDIFYCAHVVALSLYRIRKPDQVKLRLPISETLFQMNRDQLQKFIQYLITAHHTEVLPTAQKLADEILSSNSEINQVNGAPDPTAGASIDDENCWHLDEEQVKEQVKLFLSQGGYCGSGKQLNSMFAKVREMLRMRDSNGARMLTLITEQFVADPRLTLWRQQGTNMTDKCRQLWDELGALWVCIILNPHCKLEEKSCWLQQLQKWSDLDVCPLEDGNYGHELPNITNALPQSAIHSPDSLSRPRRTVFTRAIEGRELHWQDSHLQRIISSDVYTAPACQRESERLLFNSQGQPLWLEHVPTACARVDALRSHGYPKEALRLTVAIINTLRLQQQRQLEIYKHQKKELLQRGTTTITNLEGWVGHPLDPIDCLFLTLTEACRLNDDGYLEMSDMNESRPPVYQHVPVAAGSPNSSESYLSLALEVALMGLGQQRLMPEGLYAQDKVCRNEEQLLSQLQELQLDDELVQTLQKQCILLLEGGPFSGLGEVIHRESVPMHTFAKYLFSALLPHDPDLSYKLALRAMRLPVLENSASAGDTSHPHHMVSVVPSRYPRWFTLGHLESQQCELASTMLTAAKGDTLRLRTILEAIQKHIHSSSLIFKLAQDAFKIATPTDSSTDSTLLNVALELGLQVMRMTLSTLNWRRREMVRWLVTCATEVGVRALVSILQSWYTLFTPTEATSIVAATAVSHTTILRLSLDYPQREELASCARTLALQCAMKDPQSCALSALTLCEKDHIAFEAAYQIAIDAAAGGMTHSQLFTIARYMELRGYPLRAFKLASLAMSHLNLAYNQDTHPAINDVLWACALSHSLGKNELAALIPLVVKSVHCATVLSDILRRCTVTAPGLAGIPGRRSSGKLMSTDKAPLRQLLDATINAYINTTHSRLTHISPRHYGEFIEFLSKARETFLLPQDGHLQFAQFIDNLKQIYKGKKKLMLLVRERFG

SEQ ID NO: 17673 - protein, 1215 aa, Homo sapiens
MAERGQQPPPAKRLCCRPGGGGGGGGSSGGGGGAGGGYSSACRPGPRAGGAAAAAACGGGAALGLLPPGKTQSPESLLDIAARRVAEKWPFQRVEERFERIPEPVQRRIVYWSFPRSEREICMYSSFNTGGGAAGGPGDDSGGGGGAGGGGGGGSSSSPAATSAAATSAAAAAAAAAAAAAAAAGAGAPSVGAAGAADGGDETRLPFRRGIALLESGCVDNVLQVGFHLSGTVTEPAIQSEPETVCNVAISFDRCKITSVTCSCGNKDIFYCAHVVALSLYRIRKPDQVKLHLPISETLFQMNRDQLQKFVQYLITVHHTEVLPTAQKLADEILSQNSEINQVHGAPDPTAGASIDDENCWHLDEEQVQEQVKLFLSQGGYHGSGKQLNLLFAKVREMLKMRDSNGARMLTLITEQFMADPRLSLWRQQGTAMTDKYRQLWDELGALWMCIVLNPHCKLEQKASWLKQLKKWNSVDVCPWEDGNHGSELPNLTNALPQGANANQDSSNRPHRTVFTRAIEACDLHWQDSHLQHIISSDLYTNYCYHDDTENSLFDSRGWPLWHEHVPTACARVDALRSHGYPREALRLAIAIVNTLRRQQQKQLEMFRTQKKELPHKNITSITNLEGWVGHPLDPVGTLFSSLMEACRIDDENLSGFSDFTENMGQCKSLEYQHLPAHKFLEEGESYLTLAVEVALIGLGQQRIMPDGLYTQEKVCRNEEQLISKLQEIELDDTLVKIFRKQAVFLLEAGPYSGLGEIIHRESVPMHTFAKYLFTSLLPHDAELAYKIALRAMRLLVLESTAPSGDLTRPHHIASVVPNRYPRWFTLSHIESQQCELASTMLTAAKGDVRRLETVLESIQKNIHSSSHIFKLAQDAFKIATLMDSLPDITLLKVSLELGLQVMRMTLSTLNWRRREMVRWLVTCATEVGVYALDSIMQTWFTLFTPTEATSIVATTVMSNSTIVRLHLDCHQQEKLASSARTLALQCAMKDPQNCALSALTLCEKDHIAFETAYQIVLDAATTGMSYTQLFTIARYMEHRGYPMRAYKLATLAMTHLNLSYNQDTHPAINDVLWACALSHSLGKNELAAIIPLVVKSVKCATVLSDILRRCTLTTPGMVGLHGRRNSGKLMSLDKAPLRQLLDATIGAYINTTHSRLTHISPRHYSEFIEFLSKARETFLMAHDGHIQFTQFIDNLKQIYKGKKKLMMLVRERFG

SEQ ID NO: 17674 - protein, 2961 aa, Homo sapiens
MGNAPSHSSEDEAAAAGGEGWGPHQDWAAVSGTTPGPGVAAPALPPAAALLEPARLREAAAALLPTPPCESLVSRHRGALFRWLEERLGRGEESVTLEQFRELLEARGAGCSSEQFEEAFAQFDAEGDGTVDAENMLEALKNSSGANLQGELSHIIRQLQACSLVPGFTDIFSESKEGLDIHSSMILRFLHRNRLSSAVMPYPMLEHCNNMCTMRSSVLKESLDQLVQKEKESPGDLTRSPEMDKLKSVAKCYAYIETSSNSADIDKMTNGETSSYWQSDGSACSHWIRLKMKPDVVLRHLSIAVAATDQSYMPQQVTVAVGRNASDLQEVRDVHIPSNVTGYVTLLENANVSQLYVQINIKRCLSDGCDTRIHGLRAVGFQRVKKSGVSVSDASAIWYWSLLTSLVTASMETNPAFVQTVLHNTQKALRHMPPLSLSPGSTDFSTFLSPNVLEEVDSFLIRITSCCSTPEVELTLLAFALARGSVAKVMSSLCTITDHLDTQYDASSLILSMASVRQNLLLKYGKPLQLTLQACDVKGKEDKSGPENLLVEPWTRDGFLTETGKTRASTIFSTGTESAFQVTQIRIMVRRGGIGAQCGLVFAYNSSSDKFCAEEHFKRFEKYDKWKLQELRQFVKSRIGCSSDDLGEDDPIGWFELEEEWDEADVKLQQCRVAKYLMVKFLCTRQESAERLGVQGLTISGYLRPARAEAEQSVTCAHCRKDTEESVCGATLLLRTLQFIQQLAHDLVQQKESGLKYKSFLDFAGLDLQIFWNFYSKLKQNPREECVSAQTLLLQLLQSCFSVLQGDVLAASEEEKAPIQSPKGVEAAKELYTHLCDVVDKVDGDSVPMEILKQEVRNTLLNGAAIFFPNRQTRRNHLFTMMNVTEQEHKQSLQLTFRSLCTYFSDKDPGGLLLLPEKNDLAKMNISEVLAVMDTLVSVAARECELLMLSGAPGEVGSVLFSLFWSVQGSLLSWCYLQLKSTDSGAKDLAVDLIEKYVGQFLASMRAILESLFSQYSGKTIVERLCNSVFSMAARQLVIFLLDFCTLDIPHCVLLREFSVLTELLKKLCSGPEGGLRKLDVETWQQEQPVVLHTWTKESAHNYENNCHEVSVFVSPGATYFEVEFDDRCETEKRYDYLEFTDARGRKTRYDTKVGTDKWPKKVTFKAGPRLQFLFHSDSSHNEWGYKFTVTACGLPDVAVSWGLDLQLLVSRLMGRLASQCMALKSVRQLGSNMVVPQAKMALVLSSPLWKPVFRHQVCPELELEASWPTHPHRNSKEVKNIPDDPCRHFLLDFAQSEPAQNFCGPYSELFKGFIQACRKQAPKTDIVAGSTIDQAVNATFAALVYRTPDLYEKLQKYVNSGGKIALSEEFAQVYSLADGIRIWMLEMKQKSLMSLGNEAEEKHSSEATEVNPESLAKECIEKSLLLLKFLPTGISSKESCEKLETADETSHLQPLNKRQRTSSVVEEHFQASVSPTEAAPPATGDQSPGLGTQPKLPSSSGLPAADVSPATAEEPLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQELGVLQDYLLALTTDDHLLRCAAQALQNIAAISLAINYPNKATRLWNVEC

SEQ ID NO: 17675 - protein, 195 aa, Homo sapiens
MGVWGKKHLRLTHAPSPTFSHLPPSPQAGEPGIDGISLAVVCAAFIRIHPARRHPARNGSRLACTPTPRPNAGLEVVSSARVAASLPSEGGWTSGAPRSSGLSLPGSAWQPPPLPVLRKPAWPGSPAVKNESKFPNRGSRNFPRRRLPPAPVSGEPPERCKLAREIRWRLWKAHEGWGGGAKRPLGDPAWSGVKR

SEQ ID NO: 17676 - protein, 2623 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCAGQQLSD

SEQ ID NO: 17677 - protein, 2688 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCAMECPAGTIYQSCMTPCPASCANLADPGDCEGPCVEGCASIPGYAYSGTQSLPWLTVAAPAMASTTSWAAAF

SEQ ID NO: 17678 - protein, 1184 aa, Homo sapiens
MACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNITCFQSTCKPNQICWALDGLLRRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLSLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAGLYQRRRRDKGRSWASARASKCPNVARSSWRATAPRPVGCWQTPRAPLLPVTRRWPQSPSKSTACWICALLRTQESKRSCVARSSVGTPSSARRRALPWLAGGTAPSALGSSFLTEDCSQRCTCASSRILLCEPFSCRAGEVCTLGNHTQGCFPESPCLQNPCQNDGQCREQGATFTCECEVGYGGGLCMEPRDAPPPRKPEASNLVGVLLGLLVPVVVVLLAVTRECIYRTRRKREKTQEGDRLARLVDTDTVLDCAC

SEQ ID NO: 17679 - protein, 2720 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCESPCLQNPCQNDGQCREQGATFTCECEVGYGGGLCMEPRDAPPPRKPASNLVGVLLGLLVPVVVVLLAVTRECIYRTRRKREKTQEGDRLARLVDTDTVLDCAC

SEQ ID NO: 17680 - protein, 759 aa, Homo sapiens
MVHFLHPGHTPRNIVPPDAQKDALGCCVVQEEASPYTLVNICLNVLIANLEKLCSERPDGTLCLPEHWSFPQEVAERFLRVMTWQGKLTDRTASIFRGNQMKLKLVNIQKAKISTAAFIKAFCRHKLIELNATAVHADLPVPDIISGLCSNRWIQQNLQCLLLDSTSIPQNSRLLFFSQLTGLRILSVFNVCFHTEDLANVSQLPRLESLDISNTLVTDISALLTCKDRLKSLTMHYLKCLAMTKSQILAVIRELKCLLHLDISDHRQLKSDLAFHLLQQKDILPNVVSLDISGGNCITDEAVELFIRLRPAMQFVGLLATDAGSSDFFTTKQGLRVAGGASMSQISEALSRYRNRSCFVKEALHRLFTETFSMEVTMPAILKLVAIGMRNHPLDLRVQFTASACALNLTRQGLAKGMPVRLLSEVTCLLFKALKNFPHYQQLQKNCLLSLTNSRILVDVPFDRFDAAKFVMRWLCKHENPKMQTMAVSVTSILALQLSPEQTAQLEELFMAVKELLAIVKQKTTENLDDVTFLFTLKALWNLTDGSPAACKHFIENQGLQIFIQVLETFSESAIQSKVLGLLNNIAEVRELSSKLVTEDVLKHINSLLCSREMEVSYFAAGIIAHLTSDRQLWISRDFQRRTLLQDLHATIQNWPSSSCKMTALVTYRSFKTFFPLLGNFSQPEVQLWALWAMYHVCSKNPSKYCKMLVEEEGLQLLCDIQEHSEATPKAQQIAASILDDFRMHFMNYQRPTLCQMPF

SEQ ID NO: 17681 - protein, 417 aa, Homo sapiens
MSQISEALSRYRNRSCFVKEALHRLFTETFSMEVTMPAILKLVAIGMRNHPLDLRVQFTASACALNLTRQGLAKGMPVRLLSEVTCLLFKALKNFPHYQQLQKNCLLSLTNSRILVDVPFDRFDAAKFVMRWLCKHENPKMQTMAVSVTSILALQLSPEQTAQLEELFMAVKELLAIVKQKTTENLDDVTFLFTLKALWNLTDGSPAACKHFIENQGLQIFIQVLETFSESAIQSKVLGLLNNIAEVRELSSKLVTEDVLKHINSLLCSREMEVSYFAAGIIAHLTSDRQLWISRDFQRRTLLQDLHATIQNWPSSSCKMTALVTYRSFKTFFPLLGNFSQPEVQLWALWAMYHVCSKNPSKYCKMLVEEEGLQLLCDIQEHSEATPKAQQIAASILDDFRMHFMNYQRPTLCQMPF

SEQ ID NO: 17682 - protein, 744 aa, Homo sapiens
MPEDQAGAAMEEASPYSLLDICLNFLTTHLEKFCSARQDGTLCLQEPGVFPQEVADRLLRTMAFHGLLNDGTVGIFRGNQMRLKRACIRKAKISAVAFRKAFCHHKLVELDATGVNADITITDIISGLGSNKWIQQNLQCLVLNSLTLSLEDPYERCFSRLSGLRALSITNVLFYNEDLAEVASLPRLESLDISNTSITDITALLACKDRLKSLTMHHLKCLKMTTTQILDVVRELKHLNHLDISDDKQFTSDIALRLLEQKDILPNLVSLDVSGRKHVTDKAVEAFIQQRPSMQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRQLLQIVKQKTNQNSVDTTLKFTLSALWNLTDESPTTCRHFIENQGLELFMRVLESFPTESSIQQKVLGLLNNIAEVQELHSELMWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 17683 - protein, 674 aa, Homo sapiens
MPEDQAGAAMEEASPYSLLDICLNFLTTHLEKFCSARQDGTLCLQEPGVFPQEVADRLLRTMAFHGLLNDGTVGIFRGNQMRLKRACIRKAKISAVAFRKAFCHHKLVELDATGVNADITITDIISGLGSNKWIQQNLQCLVLNSLTLSLEDPYERCFSRLSGLRALSITNVLFYNEDLAEVASLPRLESLDISNTSITDITALLACKDRLKSLTMHHLKCLKMTTTQILDVVRELKHLNHLDISDDKQFTSDIALRLLEQKDILPNLVSLDVSGRKHVTDKAVEAFIQQRPSMQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRNNIAEVQELHSELMWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 17684 - protein, 566 aa, Homo sapiens
MPEDQAGAAMEEASPYSLLDICLNFLTTHLEKFCSARQDGTLCLQEPGVFPQEVADRLLRTMAFHGLLNDGTVGIFRGNQMRLKRACIRKAKISAVAFRKAFCHHKLVELDATGVNADITITDIISGLGSNKWIQQNLQCLVLNSLTLSLEDPYERCFSRLSGLRALSITNVLFYNEDLAEVASLPRLESLDISNTSITDITALLACKDRLKSLTMHHLKCLKMTTTQILDVVRELKHLNHLDISDDKQFTSDIALRLLEQKDILPNLVSLDVSGRKHVTDKAVEAFIQQRPSMQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRQLLQIVKQKTNQNSVDTTLKFTLSALWNLTDESPTTCRHFIENQGLELFMRVLESFPTESSIQQKVLGLLG

SEQ ID NO: 17685 - protein, 321 aa, Homo sapiens
MERFVRVPYGLYQGYGSTVPLGQPGLSGHKQPDWRQNMGPPTFLARPGLLVPANAPDYCIDPYKRAQLKAILSQMNPSLSPRLCKPNTKEVGVQVSPRVDKAVQCSLGPRTLSSCSPWDGRDPQEPLPACGVTSPATGRRGLIRLRRDGDEAESKALPGPAEASQPQPPSRRSGADRQEEPGQLEESGEKDAPCPQETKSKQVPGDAASEPLRRPNFQFLEPKYGYFHCKDCKTRWESAYVWCISGTNKVYFKQLCCKCQKSFNPYRVEAIQCQTCSKSHCSCPQKKRHIDLRRPHRQELCGRCKDKRFSCGNIYSFKYVM

SEQ ID NO: 17686 - protein, 25 aa, Homo sapiens
MERFVRVPYGLYQGYGSTVPLGQPG

SEQ ID NO: 17687 - protein, 167 aa, Homo sapiens
MLTVALLALLCASASGNAIQARSSSYSGEYGGGGGKRFSHSGNQLDGPITALRVRVNTYYIVGLQVRYGKVWSDYVGGRNGDLEEIFLHPGESVIQVSGKYKWYLKKLLFVTDKGRYLSFGKDSGTSFNAVPLHPNTVLRFISGRSGSLIDAIGLHWDVYPSSCSRC

SEQ ID NO: 17688 - DNA, 489 bp, Artificial Sequence
  Description of Artificial Sequence: Synthetic coding sequence
  Description of Combined DNA/RNA Molecule: Synthetic coding sequence
atggccgccggccccagcggctgcctggtgcccgccttcggcctgagactgctgctggccaccgtgctgcaggccgtgagcgccttcggcgccgagttcagcagcgaggcctgcagagagctgggcttcagcagcaacctgctgtgcagcagctgcgacctgctgggccagttcaacctgctgcagctggaccccgactgcagaggctgctgccaggaggaggcccagttcgagaccaagaagctgtacgccggcgccatcctggaggtgtgcggcugaaagctgggcagattcccccaggtgcaggccttcgtgagaagcgacaagcccaagctgttcagaggcctgcagatcaagtacgtgagaggcagcgaccccgtgctgaagctgctggacgacaacggcaacatcgccgaggagctgagcatcctgaagtggaacaccgacagcgtggaggagttcctgagcgagaagctggagagaatctag

SEQ ID NO: 17689 - DNA, 366 bp, Artificial Sequence
  Description of Artificial Sequence: Synthetic coding sequence
  Description of Combined DNA/RNA Molecule: Synthetic coding sequence
atggccgccggccccagcggctgcctggtgcccgccttcggcctgagactgctgctggccaccgtgctgcaggccgtgagcgccttcggcgccgagttcagcagcgaggcctgcagagagctgggcttcagcagcaacctgctgtgcagcagctgcgacctgctgggccagttcaacctgctgcagctggaccccgactgcagaggctgctgccaggaggaggcccagttcgagaccaagaagctgtacgccggcgccatcctggaggtgtgcggcugaaagctgggcagattcccccaggtgcaggtgtgcccctggttcagaccctgcatcaaggccttcggcagacagtgggagcactgctag

SEQ ID NO: 17690 - DNA, 426 bp, Artificial Sequence
  Description of Artificial Sequence: Synthetic coding sequence
atggccgccggccccagcggctgcctggtgcccgccttcggcctgagactgctgctggccaccgtgctgcaggccgtgagcgccttcggcgccgagttcagcagcgaggcctgcagagagctgggcttcagcagcaacctgctgtgcagcagctgcgacctgctgggccagttcaacctgctgcagctggaccccgactgcagaggctgctgccaggaggaggcccagttcgagaccaagaagtacagcagcatcgtgagcaagcaggagtgccaccacagcaactgcatgcaggagctgttcctgaagttcgtggacgagaactgggagggcagcctgaagagcaagctgctgctgggcgtgatcaaccccaactgcagcgaggactgcaagagcagcatgagcgtggtgcagaccctgtactag

SEQ ID NO: 17691 - DNA, 1707 bp, Artificial Sequence
  Description of Artificial Sequence: Synthetic coding sequence
atgagccacagaagcgacaccctgcccgtgcccagcggccagagaagaggcagagtgcccagagaccacagcatctacacccagctgctggagatcaccctgcacctgcagcaggccatgaccgagcacttcgtgcagctgaccagcagacagggcctgagcctggaggagagaagacacaccgaggccatctgcgagcacgaggccctgctgagcagactgatctgcagaatgatcaacctgctgcagagcggcgccgccagcggcctggagctgcaggtgcccctgcccagcgaggacagcagaggcgacgtgagatacggccagagagcccagctgagcggccagcccgaccccgtgccccagctgagcgactgcgaggccgccttcgtgaacagagacctgagcatcagaggcatcgacatcagcgtgttctaccagagcagcttccaggactacaacgcctaccagaaggacaagtaccacaaggacaagaacaccctgggcttcatcaacctgggcaccagcgagaacaagctgtgcatggacctgatgaccgagagactgcaggagagcgacatgaactgcatcgaggacaccctgctgcagtaccccgactggagaggccagcccttcctgagagaggaggtggccagattcctgacctactactgcagagcccccaccagactggaccccgagaacgtggtggtgctgaacggctgctgcagcgtgttctgcgccctggccatggtgctgtgcgaccccggcgaggccttcctggtgcccgcccccttctacggcggcttcgccttcagcagcagactgtacgccaaggtggagctgatccccgtgcacctggagagcgaggtgaccgtgaccaacacccaccccttccagctgaccgtggacaagctggaggaggccctgctggaggccagactggagggcaagaaggtgagaggcctggtgctgatcaacccccagaaccccctgggcgacatctacagccccgacagcctgatgaagtacctggagttcgccaagagatacaacctgcacgtgatcatcgacgagatctacatgctgagcgtgttcgacgagagcatcaccttccacagcatcctgagcatgaagagcctgcccgacagcaacagaacccacgtgatctggggcaccagcaaggacttcggcatcagcggcttcagattcggcgccctgtacacccacaacaaggaggtggccagcgccgtgagcgccttcggctacctgcacagcatcagcggcatcacccagcacaagctgtgccagctgctgcagaacaccgagtggatcgacaaggtgtacctgcccaccaactgctacagactgagagaggcccacaagtacatcaccgccgagctgaaggccctggagatccccttccacaacagaagcagcggcctgtacgtgtggatcaacctgaagaagtacctggacccctgcaccttcgaggaggagagactgctgtactgcagattcctggacaacaagctgctgctgagcagaggcaagacctacatgtgcaaggagcccggctggttctgcctgatcttcgccgacgagctgcccagactgaagctggccatgagaagattctgcgacgtgctgcaggagcagaaggaggccctgatcgtgaagcagctggaggacgccatgagagagtag

SEQ ID NO: 17692 - DNA, 264 bp, Artificial Sequence
  Description of Artificial Sequence: Synthetic coding sequence
atggccaagcacctgaagttcatcgccagaaccgtgatggtgcaggagggcaacgtggagagcgcctacagaaccctgaacagaatcctgaccatggacggcctgatcgaggacatcaagcacagaagatactacgagaagccctgctgcagaagacagagagagagctacgagagatgcagaagaatctacaacatggagatggccagaaagatcaacttcctgatgagaaagaacagagccgacccctggcagggctgctag

SEQ ID NO: 17693 - DNA, 1629 bp, Artificial Sequence
  Description of Artificial Sequence: Synthetic coding sequence
atgaacggcaagagacccgccgagcccggccccgccagagtgggcaagaagggcaagaaggaggtgatggccgagttcagcgacgccgtgaccgaggagaccctgaagaagcaggtggccgaggcctggagcagaagaacccccttcagccacgaggtgatcgtgatggacatggaccccttcctgcactgcgtgatccccaacttcatccagagccaggacttcctggagggcctgcagaaggagctgatgaacctggacttccacgagaagtacaacgacctgtacaagttccagcagagcgacgacctgaagaagagaagagagccccacatcagcaccctgagaaagatcctgttcgaggacttcagaagctggctgagcgacatcagcaagatcgacctggagagcaccatcgacatgagctgcgccaagtacgagttcaccgacgccctgctgtgccacgacgacgagctggagggcagaagaatcgccttcatcctgtacctggtgcccccctgggacagaagcatgggcggcaccctggacctgtacagcatcgacgagcacttccagcccaagcagatcgtgaagagcctgatccccagctggaacaagctggtgttcttcgaggtgagccccgtgagcttccaccaggtgagcgaggtgctgagcgaggagaagagcagactgagcatcagcggctggttccacggccccagcctgaccagaccccccaactacttcgagccccccatccccagaagcccccacatcccccaggaccacgagatcctgtacgactggatcaaccccacctacctggacatggactaccaggtgcagatccaggaggagttcgaggagagcagcgagatcctgctgaaggagttcctgaagcccgagaagttcaccaaggtgtgcgaggccctggagcacggccacgtggagtggagcagcagaggcccccccaacaagagattctacgagaaggccgaggagagcaagctgcccgagatcctgaaggagtgcatgaagctgttcagaagcgaggccctgttcctgctgctgagcaacttcaccggcctgaagctgcacttcctggcccccagcgaggaggacgagatgaacgacaagaaggaggccgagaccaccgacatcaccgaggagggcaccagccacagcccccccgagcccgagaacaaccagatggccatcagcaacaacagccagcagagcaacgagcagaccgaccccgagcccgaggagaacgagaccaagaaggagagcagcgtgcccatgtgccagggcgagctgagacactggaagaccggccactacaccctgatccacgaccacagcaaggccgagttcgccctggacctgatcctgtactgcggctgcgagggctgggagcccgagtacggcggcttcaccagctacatcgccaagggcgaggacgaggagctgctgaccgtgaaccccgagagcaacagcctggccctggtgtacagagacagagagaccctgaagttcgtgaagcacatcaaccacagaagcctggagcagaagaagaccttccccaacagaaccggcttctgggacttcagcttcatctactacgagtag

SEQ ID NO: 17694 - DNA, 1161 bp, Artificial Sequence
  Description of Artificial Sequence: Synthetic coding sequence
atgaacagcctgatgccctgctgcgccttcatcctgtacctggtgcccccctgggacagaagcatgggcggcaccctggacctgtacagcatcgacgagcacttccagcccaagcagatcgtgaagagcctgatccccagctggaacaagctggtgttcttcgaggtgagccccgtgagcttccaccaggtgagcgaggtgctgagcgaggagaagagcagactgagcatcagcggctggttccacggccccagcctgaccagaccccccaactacttcgagccccccatccccagaagcccccacatcccccaggaccacgagatcctgtacgactggatcaaccccacctacctggacatggactaccaggtgcagatccaggaggagttcgaggagagcagcgagatcctgctgaaggagttcctgaagcccgagaagttcaccaaggtgtgcgaggccctggagcacggccacgtggagtggagcagcagaggcccccccaacaagagattctacgagaaggccgaggagagcaagctgcccgagatcctgaaggagtgcatgaagctgttcagaagcgaggccctgttcctgctgctgagcaacttcaccggcctgaagctgcacttcctggcccccagcgaggaggacgagatgaacgacaagaaggaggccgagaccaccgacatcaccgaggagggcaccagccacagcccccccgagcccgagaacaaccagatggccatcagcaacaacagccagcagagcaacgagcagaccgaccccgagcccgaggagaacgagaccaagaaggagagcagcgtgcccatgtgccagggcgagctgagacactggaagaccggccactacaccctgatccacgaccacagcaaggccgagttcgccctggacctgatcctgtactgcggctgcgagggctgggagcccgagtacggcggcttcaccagctacatcgccaagggcgaggacgaggagctgctgaccgtgaaccccgagagcaacagcctggccctggtgtacagagacagagagaccctgaagttcgtgaagcacatcaaccacagaagcctggagcagaagaagaccttccccaacagaaccggcttctgggacttcagcttcatctactacgagtag

SEQ ID NO: 17695 - DNA, 1629 bp, Artificial Sequence; identical to SEQ ID NO: 17693
  Description of Artificial Sequence: Synthetic coding sequence

SEQ ID NO: 17696 - DNA, 1308 bp, Artificial Sequence
  Description of Artificial Sequence: Synthetic coding sequence
atgctgctgccctgggccaccagcgcccccggcctggcctggggccccctggtgctgggcctgttcggcctgctggccgccagccagccccaggccgtgcccccctacgccagcgagaaccagacctgcagagaccaggagaaggagtactacgagccccagcacagaatctgctgcagcagatgcccccccggcacctacgtgagcgccaagtgcagcagaatcagagacaccgtgtgcgccacctgcgccgagaacagctacaacgagcactggaactacctgaccatctgccagctgtgcagaccctgcgaccccgtgatgggcctggaggagatcgccccctgcaccagcaagagaaagacccagtgcagatgccagcccggcatgttctgcgccgcctgggccctggagtgcacccactgcgagctgctgagcgactgcccccccggcaccgaggccgagctgaaggacgaggtgggcaagggcaacaaccactgcgtgccctgcaaggccggccacttccagaacaccagcagccccagcgccagatgccagccccacaccagatgcgagaaccagggcctggtggaggccgcccccggcaccgcccagagcgacaccacctgcaagaaccccctggagcccctgccccccgagatgagcggcaccatgctgatgctggccgtgctgctgcccctggccttcttcctgctgctggccaccgtgttcagctgcatctggaagagccaccccagcctgtgcagaaagctgggcagcctgctgaagagaagaccccagggcgagggccccaaccccgtggccggcagctgggagccccccaaggcccacccctacttccccgacctggtgcagcccctgctgcccatcagcggcgacgtgagccccgtgagcaccggcctgcccgccgcccccgtgctggaggccggcgtgccccagcagcagagccccctggacctgaccagagagccccagctggagcccggcgagcagagccaggtggcccacggcaccaacggcatccacgtgaccggcggcagcatgaccatcaccggcaacatctacatctacaacggccccgtgctgggcggcccccccggccccggcgacctgcccgccacccccgagcccccctaccccatccccgaggagggcgaccccggcccccccggcctgagcaccccccaccaggaggacggcaaggcctggcacctggccgagaccgagcactgcggcgccacccccagcaacagaggccccagaaaccagttcatcacccacgactag

SEQ ID NO: 17697 - DNA, 873 bp, Artificial Sequence
  Description of Artificial Sequence: Synthetic coding sequence
atggtggagctggagcaggaggtggagagaagacagagactgggccaggagagcgccgccagaaaggccctgatcgccagcagctaccaccccgccagacccgaggtgtacgacagcctgcaggacgccgccctggcccccgagttcctggccgtgaccgagtacagcgtgagccccgacgccgacctgaagggcctgctgcagagactggagaccgtgagcgaggagaagagaatctacagagtgcccgtgttcaccgcccccttctgccaggccctgctggaggagctggagcacttcgagcagagcgacatgcccaagggcagacccaacaccatgaacaactacggcgtgctgctgcacgagctgggcctggacgagcccctgatgacccccctgagagagagattcctgcagcccctgatggccctgctgtaccccgactgcggcggcggcagactggacagccacagagccttcgtggtgaagtacgcccccggccaggacctggagctgggctgccactacgacaacgccgagctgaccctgaacgtggccctgggcaaggtgttcaccggcggcgccctgtacttcggcggcctgttccaggcccccaccgccctgaccgagcccctggaggtggagcacgtggtgggccagggcgtgctgcacagaggcggccagctgcacggcgccagacccctgggcaccggcgagagatggaacctggtggtgtggctgagagccagcgccgtgagaaacagcctgtgccccatgtgctgcagagagcccgacctggtggacgacgagggcttcggcgacggcttcaccagagaggagcccgccaccgtggacgtgtgcgccctgacctag

SEQ ID NO: 17698 - DNA, 1023 bp, Artificial Sequence
  Description of Artificial Sequence: Synthetic coding sequence
atgggcaacgtgcccagcgccgtgaagcactgcctgagctaccagcagctgctgagagagcacctgtggatcggcgacagcgtggccggcgccctggaccccgcccaggagaccagccagctgagcggcctgcccgagttcgtgaagatcgtggaggtgggccccagagacggcctgcagaacgagaaggtgatcgtgcccaccgacatcaagatcgagttcatcaacagactgagccagaccggcctgagcgtgatcgaggtgaccagcttcgtgagcagcagatgggtgccccagatggccgaccacaccgaggtgatgaagggcatccaccagtaccccggcgtgagataccccgtgctgacccccaacctgcagggcttccaccacgccgtggccgccggcgccaccgagatcagcgtgttcggcgccgccagcgagagcttcagcaagaagaacatcaactgcagcatcgaggagagcatgggcaagttcgaggaggtggtgaagagcgccagacacatgaacatccccgccagaggctacgtgagctgcgccctgggctgcccctacgagggcagcatcaccccccagaaggtgaccgaggtgagcaagagactgtacggcatgggctgctacgagatcagcctgggcgacaccatcggcgtgggcacccccggcagcatgaagagaatgctggagagcgtgatgaaggagatcccccccggcgccctggccgtgcactgccacgacacctacggccaggccctggccaacatcctgaccgccctgcagatgggcatcaacgtggtggacagcgccgtgagcggcctgggcggctgcccctacgccaagggcgccagcggcaacgtggccaccgaggacctgatctacatgctgaacggcctgggcctgaacaccggcgtgaacctgtacaaggtgatggaggccggcgacttcatctgcaaggccgtgaacaagaccaccaacagcaaggtggcccaggccagcttcaacgcctag

SEQ ID NO: 17699 - DNA, 162 bp, Artificial Sequence
  Description of Artificial Sequence: Synthetic coding sequence
atgggcaacgtgcccagcgccgtgaagcactgcctgagctaccagcagctgctgagagagcacctgtggatcggcgacagcgtggccggcgccctggaccccgcccaggagctgcagagcgtgatgctgatgctgcaccacggccccctgagaaagccctag

SEQ ID NO: 17700 - DNA, 1113 bp, Artificial Sequence
  Description of Artificial Sequence: Synthetic coding sequence
atgggcaacgtgcccagcgccgtgaagcactgcctgagctaccagcagctgctgagagagcacctgtggatcggcgacagcgtggccggcgccctggaccccgcccagaccagcctgctgaccaacctgcactgcttccagcccgacgtgagcggcttcagcgtgagcctggccggcaccgtggcctgcatccactgggagaccagccagctgagcggcctgcccgagttcgtgaagatcgtggaggtgggccccagagacggcctgcagaacgagaaggtgatcgtgcccaccgacatcaagatcgagttcatcaacagactgagccagaccggcctgagcgtgatcgaggtgaccagcttcgtgagcagcagatgggtgccccagatggccgaccacaccgaggtgatgaagggcatccaccagtaccccggcgtgagataccccgtgctgacccccaacctgcagggcttccaccacgccgtggccgccggcgccaccgagatcagcgtgttcggcgccgccagcgagagcttcagcaagaagaacatcaactgcagcatcgaggagagcatgggcaagttcgaggaggtggtgaagagcgccagacacatgaacatccccgccagaggctacgtgagctgcgccctgggctgcccctacgagggcagcatcaccccccagaaggtgaccgaggtgagcaagagactgtacggcatgggctgctacgagatcagcctgggcgacaccatcggcgtgggcacccccggcagcatgaagagaatgctggagagcgtgatgaaggagatcccccccggcgccctggccgtgcactgccacgacacctacggccaggccctggccaacatcctgaccgccctgcagatgggcatcaacgtggtggacagcgccgtgagcggcctgggcggctgcccctacgccaagggcgccagcggcaacgtggccaccgaggacctgatctacatgctgaacggcctgggcctgaacaccggcgtgaacctgtacaaggtgatggaggccggcgacttcatctgcaaggccgtgaacaagaccaccaacagcaaggtggcccaggccagcttcaacgcctag

SEQ ID NO: 17701 - DNA, 1116 bp, Artificial Sequence
  Description of Artificial Sequence: Synthetic coding sequence
atggccgcccccgccctgagactgtgccacatcgccttccacgtgcccgccggccagcccctggccagaaacctgcagagactgttcggcttccagcccctggccagcagagaggtggacggctggagacagctggccctgagaagcggcgacgccgtgttcctggtgaacgagggcgccggcagcggcgagcccctgtacggcctggaccccagacacgccgtgcccagcgccaccaacctgtgcttcgacgtggccgacgccggcgccgccaccagagagctggccgccctgggctgcagcgtgcccgtgccccccgtgagagtgagagacgcccagggcgccgccacctacgccgtggtgagcagccccgccggcatcctgagcctgaccctgctggagagagccggctacagaggccccttcctgcccggcttcagacccgtgagcagcgcccccggccccggctgggtgagcagagtggaccacctgaccctggcctgcacccccggcagcagccccaccctgctgagatggttccacgactgcctgggcttctgccacctgcccctgagccccggcgaggaccccgagctgggcctggagatgaccgccggcttcggcctgggcggcctgagactgaccgccctgcaggcccagcccggcagcatcgtgcccaccctggtgctggccgagagcctgcccggcgccaccaccagacaggaccaggtggagcagttcctggccagacacaagggccccggcctgcagcacgtgggcctgtacacccccaacatcgtggaggccaccgagggcgtggccaccgccggcggccagttcctggccccccccggcgcctactaccagcagcccggcaaggagagacagatcagagccgccggccacgagccccacctgctggccagacagggcatcctgctggacggcgacaagggcaagttcctgctgcaggtgttcaccaagagcctgttcaccgaggacaccttcttcctggagctgatccagagacagggcgccaccggcttcggccagggcaacatcagagccctgtggcagagcgtgcaggagcagagcgccagaagccaggaggcctag

SEQ ID NO: 17702 - DNA, 1368 bp, Artificial Sequence
  Description of Artificial Sequence: Synthetic coding sequence
atggcccagcacttcagcctggccgcctgcgacgtggtgggcttcgacctggaccacaccctgtgcagatacaacctgcccgagagcgcccccctgatctacaacagcttcgcccagttcctggtgaaggagaagggctacgacaaggagctgctgaacgtgacccccgaggactgggacttctgctgcaagggcctggccctggacctggaggacggcaacttcctgaagctggccaacaacggcaccgtgctgagagccagccacggcaccaagatgatgacccccgaggtgctggccgaggcctacggcaagaaggagtggaagcacttcctgagcgacaccggcatggcctgcagaagcggcaagtactacttctacgacaactacttcgacctgcccggcgccctgctgtgcgccagagtggtggactacctgaccaagctgaacaacggccagaagaccttcgacttctggaaggacatcgtggccgccatccagcacaactacaagatgagcgccttcaaggagaactgcggcatctacttccccgagatcaagagagaccccggcagatacctgcacagctgccccgagagcgtgaagaagtggctgagacagctgaagaacgccggcaagatcctgctgctgatcaccagcagccacagcgactactgcagactgctgtgcgagtacatcctgggcaacgacttcaccgacctgttcgacatcgtgatcaccaacgccctgaagcccggcttcttcagccacctgcccagccagagacccttcagaaccctggagaacgacgaggagcaggaggccctgcccagcctggacaagcccggctggtacagccagggcaacgccgtgcacctgtacgagctgctgaagaagatgaccggcaagcccgagcccaaggtggtgtacttcggcgacagcatgcacagcgacatcttccccgccagacactacagcaactgggagaccgtgctgatcctggaggagctgagaggcgacgagggcaccagaagccagagacccgaggagagcgagcccctggagaagaagggcaagtacgagggccccaaggccaagcccctgaacaccagcagcaagaagtggggcagcttcttcatcgacagcgtgctgggcctggagaacaccgaggacagcctggtgtacacctggagctgcaagagaatcagcacctacagcaccatcgccatccccagcatcgaggccatcgccgagctgcccctggactacaagttcaccagattcagcagcagcaacagcaagaccgccggctactaccccaacccccccctggtgctgagcagcgacgagaccctgatcagcaagtag

SEQ ID NO: 17703 - DNA, 588 bp, Artificial Sequence
  Description of Artificial Sequence: Synthetic coding sequence
atggcccagcacttcagcctggccgcctgcgacgtggtgggcttcgacctggaccacaccctgtgcagatacaacctgcccgagagcgcccccctgatctacaacagcttcgcccagttcctggtgaaggagaagggctacgacaaggagctgctgaacgtgacccccgaggactgggacttctgctgcaagggcctggccctggacctggaggacggcaacttcctgaagctggccaacaacggcaccgtgctgagagccagccacggcaccaagatgatgacccccgaggtgctggccgaggcctacggcaagaaggagtggaagcacttcctgagcgacaccggcatggcctgcagaagcggcaagtactacttctacgacaactacttcgacctgcccggcgccctgctgtgcgccagagtggtggactacctgaccaagctgaacaacggccagaagaccttcgacttctggaaggacatcgtggccgccatccagcacaactacaagatgagcgccttcaaggtgagaagactggccaccagcctgctgcaggacatcagcaccagcttcatcctgatctag

SEQ ID NO: 17704 - DNA, 336 bp, Artificial Sequence
  Description of Artificial Sequence: Synthetic coding sequence
tgaagccacggcaccaagatgatgacccccgaggtgctggccgaggcctacggcaagaaggagtggaagcacttcctgagcgacaccggcatggcctgcagaagcggcaagtactacttctacgacaactacttcgacctgcccggcgccctgctgtgcgccagagtggtggactacctgaccaagctgaacaacggccagaagaccttcgacttctggaaggacatcgtggccgccatccagcacaactacaagatgagcgccttcaagggcaagtactgcgaggagggccccagcaacacctgcctgctgagctacgtgtgcctggtgaactag

SEQ ID NO: 17705 - DNA, 588 bp, Artificial Sequence; identical to SEQ ID NO: 17703
  Description of Artificial Sequence: Synthetic coding sequence

SEQ ID NO: 17706 - DNA, 1563 bp, Artificial Sequence
  Description of Artificial Sequence: Synthetic coding sequence
atgagagtggagagcggcagcgcccaggagagaggcatcctgctggagagcctgagcaccctgctggagaagaccaccgccagccacgagggcagagcccccggcaacagagagctgaccgacctgctgccccccgaggtgtgcagcctgctgaaccccgccgccatctacgccaacaacgagatcagcctgagagacgtggaggtgtacggcttcgactacgactacaccctggcccagtacgccgacgccctgcaccccgagatcttcagcaccgccagagacatcctgatcgagcactacaagtaccccgagggcatcagaaagtacgactacaaccccagcttcgccatcagaggcctgcactacgacatccagaagagcctgctgatgaagatcgacgccttccactacgtgcagctgggcaccgcctacagaggcctgcagcccgtgcccgacgaggaggtgatcgagctgtacggcggcacccagcacatccccctgtaccagatgagcggcttctacggcaagggccccagcatcaagcagttcatggacatcttcagcctgcccgagatggccctgctgagctgcgtggtggactacttcctgggccacagcctggagttcgaccaggcccacctgtacaaggacgtgaccgacgccatcagagacgtgcacgtgaagggcctgatgtaccagtggatcgagcaggacatggagaagtacatcctgagaggcgacgagaccttcgccgtgctgagcagactggtggcccacggcaagcagctgttcctgatcaccaacagccccttcagcttcgtggacaagggcatgagacacatggtgggccccgactggagacagctgttcgacgtggtgatcgtgcaggccgacaagcccagcttcttcaccgacagaagaaagcccttcagaaagctggacgagaagggcagcctgcagtgggacagaatcaccagactggagaagggcaagatctacagacagggcaacctgttcgacttcctgagactgaccgagtggagaggccccagagtgctgtacttcggcgaccacctgtacagcgacctggccgacctgatgctgagacacggctggagaaccggcgccatcatccccgagctggagagagagatcagaatcatcaacaccgagcagtacatgcacagcctgacctggcagcaggccctgaccggcctgctggagagaatgcagacctaccaggacgccgagagcagacaggtgctggccgcctggatgaaggagagacaggagctgagatgcatcaccaaggccctgttcaacgcccagttcggcagcatcttcagaaccttccacaaccccacctacttcagcagaagactggtgagattcagcgacctgtacatggccagcctgagctgcctgctgaactacagagtggacttcaccttctaccccagaagaacccccctgcagcacgaggcccccctgtggatggaccagctgtgcaccggctgcatgaagacccccttcctgggcgacatggcccacatcagatag

SEQ ID NO: 17707 - DNA, 1386 bp, Artificial Sequence
  Description of Artificial Sequence: Synthetic coding sequence
atgagaagactggtgcacgacctgctgccccccgaggtgtgcagcctgctgaaccccgccgccatctacgccaacaacgagatcagcctgagagacgtggaggtgtacggcttcgactacgactacaccctggcccagtacgccgacgccctgcaccccgagatcttcagcaccgccagagacatcctgatcgagcactacaagagcctgctgatgaagatcgacgccttccactacgtgcagctgggcaccgcctacagaggcctgcagcccgtgcccgacgaggaggtgatcgagctgtacggcggcacccagcacatccccctgtaccagatgagcggcttctacggcaagggccccagcatcaagcagttcatggacatcttcagcctgcccgagatggccctgctgagctgcgtggtggactacttcctgggccacagcctggagttcgaccaggcccacctgtacaaggacgtgaccgacgccatcagagacgtgcacgtgaagggcctgatgtaccagtggatcgagcaggacatggagaagtacatcctgagaggcgacgagaccttcgccgtgctgagcagactggtggcccacggcaagcagctgttcctgatcaccaacagccccttcagcttcgtggacaagggcatgagacacatggtgggccccgactggagacagctgttcgacgtggtgatcgtgcaggccgacaagcccagcttcttcaccgacagaagaaagcccttcagaaagctggacgagaagggcagcctgcagtgggacagaatcaccagactggagaagggcaagatctacagacagggcaacctgttcgacttcctgagactgaccgagtggagaggccccagagtgctgtacttcggcgaccacctgtacagcgacctggccgacctgatgctgagacacggctggagaaccggcgccatcatccccgagctggagagagagatcagaatcatcaacaccgagcagtacatgcacagcctgacctggcagcaggccctgaccggcctgctggagagaatgcagacctaccaggacgccgagagcagacaggtgctggccgcctggatgaaggagagacaggagctgagatgcatcaccaaggccctgttcaacgcccagttcggcagcatcttcagaaccttccacaaccccacctacttcagcagaagactggtgagattcagcgacctgtacatggccagcctgagctgcctgctgaactacagagtggacttcaccttctaccccagaagaacccccctgcagcacgaggcccccctgtggatggaccagctgtgcaccggctgcatgaagacccccttcctgggcgacatggcccacatcagatag

SEQ ID NO: 17708 - DNA, 1674 bp, Artificial Sequence
  Description of Artificial Sequence: Synthetic coding sequence
atggccggcgccggcctgagagccgccgccagaagatggctgctgtgcggcggccacggcggccccagagccgccagcagcagccccagctgccccggctgcggcccccccggccccggcgcccactgccccggcgtgcccagaagcgcccccgcccaggcccccaccagcggcgccgacctgagcgcccacctgtgggccagataccaggacatgagaagactggtgcacgacctgctgccccccgaggtgtgcagcctgctgaaccccgccgccatctacgccaacaacgagatcagcctgagagacgtggaggtgtacggcttcgactacgactacaccctggcccagtacgccgacgccctgcaccccgagatcttcagcaccgccagagacatcctgatcgagcactacaagtaccccgagggcatcagaaagtacgactacaaccccagcttcgccatcagaggcctgcactacgacatccagaagagcctgctgatgaagatcgacgccttccactacgtgcagctgggcaccgcctacagaggcctgcagcccgtgcccgacgaggaggtgatcgagctgtacggcggcacccagcacatccccctgtaccagatgagcggcttctacggcaagggccccagcatcaagcagttcatggacatcttcagcctgcccgagatggccctgctgagctgcgtggtggactacttcctgggccacagcctggagttcgaccaggcccacctgtacaaggacgtgaccgacgccatcagagacgtgcacgtgaagggcctgatgtaccagtggatcgagcaggacatggagaagtacatcctgagaggcgacgagaccttcgccgtgctgagcagactggtggcccacggcaagcagctgttcctgatcaccaacagccccttcagcttcgtggacaagggcatgagacacatggtgggccccgactggagacagctgttcgacgtggtgatcgtgcaggccgacaagcccagcttcttcaccgacagaagaaagcccttcagaaagctggacgagaagggcagcctgcagtgggacagaatcaccagactggagaagggcaagatctacagacagggcaacctgttcgacttcctgagactgaccgagtggagaggccccagagtgctgtacttcggcgaccacctgtacagcgacctggccgacctgatgctgagacacggctggagaaccggcgccatcatccccgagctggagagagagatcagaatcatcaacaccgagcagtacatgcacagcctgacctggcagcaggccctgaccggcctgctggagagaatgcagacctaccaggacgccgagagcagacaggtgctggccgcctggatgaaggagagacaggagctgagatgcatcaccaaggccctgttcaacgcccagttcggcagcatcttcagaaccttccacaaccccacctacttcagcagaagactggtgagattcagcgacctgtacatggccagcctgagctgcctgctgaactacagagtggacttcaccttctaccccagaagaacccccctgcagcacgaggcccccctgtggatggaccagctgtgcaccggctgcatgaagacccccttcctgggcgacatggcccacatcagatag

SEQ ID NO: 17709 - DNA, 2538 bp, Artificial Sequence
  Description of Artificial Sequence: Synthetic coding sequence
atgagcgacgacatcgactggctgagaagccacagaggcgtgtgcaaggtggacctgtacaaccccgagggccagcaggaccaggacagaaaggtgatctgcttcgtggacgtgagcaccctgaacgtggaggacaaggactacaaggacgccgccagcagcagcagcgagggcaacctgaacctgggcagcctggaggagaaggagatcatcgtgatcaaggacaccgagaagaaggaccagagcaagaccgagggcagcgtgtgcctgttcaagcaggcccccagcgaccccgtgagcgtgctgaactggctgctgagcgacctgcagaagtacgccctgggcttccagcacgccctgagccccagcaccagcacctgcaagcacaaggtgggcgacaccgagggcgagtaccacagagccagcagcgagaactgctacagcgtgtacgccgaccaggtgaacatcgactacctgatgaacagaccccagaacctgagactggagatgaccgccgccaagaacaccaacaacaaccagagccccagcgccccccccgccaagccccccagcacccagagagccgtgatcagccccgacggcgagtgcagcatcgacgacctgagcttctacgtgaacagactgagcagcctggtgatccagatggcccacaaggagatcaaggagaagctggagggcaagagcaagtgcctgcaccacagcatctgccccagccccggcaacaaggagagaatcagccccagaacccccgccagcaagatcgccagcgagatggcctacgaggccgtggagctgaccgccgccgagatgagaggcaccggcgaggagagcagagagggcggccagaagagcttcctgtacagcgagctgagcaacaagagcaagagcggcgacaagcagatgagccagagagagagcaaggagttcgccgacagcatcagcaagggcctgatggtgtacgccaaccaggtggccagcgacatgatggtgagcctgatgaagaccctgaaggtgcacagcagcggcaagcccatccccgccagcgtggtgctgaagagagtgctgctgagacacaccaaggagatcgtgagcgacctgatcgacagctgcatgaagaacctgcacaacatcaccggcgtgctgatgaccgacagcgacttcgtgagcgccgtgaagagaaacctgttcaaccagtggaagcagaacgccaccgacatcatggaggccatgctgaagagactggtgagcgccctgatcggcgaggagaaggagaccaagagccagagcctgagctacgccagcctgaaggccggcagccacgaccccaagtgcagaaaccagagcctggagttcagcaccatgaaggccgagatgaaggagagagacaagggcaagatgaagagcgacccctgcaagagcctgaccagcgccgagaaggtgggcgagcacatcctgaaggagggcctgaccatctggaaccagaagcagggcaacagctgcaaggtggccaccaaggcctgcagcaacaaggacgagaagggcgagaagatcaacgccagcaccgacagcctggccaaggacctgatcgtgagcgccctgaagctgatccagtaccacctgacccagcagaccaagggcaaggacacctgcgaggaggactgccccggcagcaccatgggctacatggcccagagcacccagtacgagaagtgcggcggcggccagagcgccaaggccctgagcgtgaagcagctggagagccacagagcccccggccccagcacctgccagaaggagaaccagcacctggacagccagaagatggacatgagcaacatcgtgctgatgctgatccagaagctgctgaacgagaaccccttcaagtgcgaggacccctgcgagggcgagaacaagtgcagcgagcccagagccagcaaggccgccagcatgagcaacagaagcgacaaggccgaggagcagtgccaggagcaccaggagctggactgcaccagcggcatgaagcaggccaacggccagttcatcgacaagctggtggagagcgtgatgaagctgtgcctgatcatggccaagtacagcaacgacggcgccgccctggccgagctggaggagcaggccgccagcgccaacaagcccaacttcagaggcaccagatgcatccacagcggcgccatgccccagaactaccaggacagcctgggccacgaggtgatcgtgaacaaccagtgcagcaccaacagcctgcagaagcagctgcaggccgtgctgcagtggatcgccgccagccagttcaacgtgcccatgctgtacttcatgggcgacaaggacggccagctggagaagctgccccaggtgagcgccaaggccgccgagaagggctacagcgtgggcggcctgctgcaggaggtgatgaagttcgccaaggagagacagcccgacgaggccgtgggcaaggtggccagaaagcagctgctggactggctgctggccaacctgtag

SEQ ID NO: 17710 - DNA, 1089 bp, Artificial Sequence
  Description of Artificial Sequence: Synthetic coding sequence
atggacgcccaggactgccaggccgccgccagccccgagccccccggcccccccgccagaagctgcgtggccgcctggtgggacatggtggacagaaacctgagatacttcccccacagctgcagcatgctgggcagaaagatcgccgccctgtacgacagcttcaccagcaagagcctgaaggagcacgtgttcctgcccctgatcgacatgctgatctacttcaacttcttcaaggcccccttcctggtggacctgaagaagcccgagctgaagatcccccacaccgtgaacttctacctgagagtggagcccggcgtgatgctgggcatctggcacaccgtgcccagctgcagaggcgaggacgccaagggcaaggactgctgctggtacgaggccgccctgagagacggcaaccccatcatcgtgtacctgcacggcagcgccgagcacagagccgccagccacagactgaagctggtgaaggtgctgagcgacggcggcttccacgtgctgagcgtggactacagaggcttcggcgacagcaccggcaagcccaccgaggagggcctgaccaccgacgccatctgcgtgtacgagtggaccaaggccagaagcggcatcacccccgtgtgcctgtggggccacagcctgggcaccggcgtggccaccaacgccgccaaggtgctggaggagaagggctgccccgtggacgccatcgtgctggaggcccccttcaccaacatgtgggtggccagcatcaactaccccctgctgaagatctacagaaacatccccggcttcctgagaaccctgatggacgccctgagaaaggacaagatcatcttccccaacgacgagaacgtgaagttcctgagcagccccctgctgatcctgcacggcgaggacgacagaaccgtgcccctggagtacggcaagaagctgtacgagatcgccagaaacgcctacagaaacaaggagagagtgaagatggtgatcttcccccccggcttccagcacaacctgctgtgcaagagccccaccctgctgatcaccgtgagagacttcctgagcaagcagtggagctag

SEQ ID NO: 17711 - DNA, 858 bp, Artificial Sequence
  Description of Artificial Sequence: Synthetic coding sequence
atggacgcccaggactgccaggccgccgccagccccgagccccccggcccccccgccagaagctgcgtggccgcctggtgggacatggtggacagaaacctgagacacaccgtgcccagctgcagaggcgaggacgccaagggcaaggactgctgctggtacgaggccgccctgagagacggcaaccccatcatcgtgtacctgcacggcagcgccgagcacagagccgccagccacagactgaagctggtgaaggtgctgagcgacggcggcttccacgtgctgagcgtggactacagaggcttcggcgacagcaccggcaagcccaccgaggagggcctgaccaccgacgccatctgcgtgtacgagtggaccaaggccagaagcggcatcacccccgtgtgcctgtggggccacagcctgggcaccggcgtggccaccaacgccgccaaggtgctggaggagaagggctgccccgtggacgccatcgtgctggaggcccccttcaccaacatgtgggtggccagcatcaactaccccctgctgaagatctacagaaacatccccggcttcctgagaaccctgatggacgccctgagaaaggacaagatcatcttccccaacgacgagaacgtgaagttcctgagcagccccctgctgatcctgcacggcgaggacgacagaaccgtgcccctggagtacggcaagaagctgtacgagatcgccagaaacgcctacagaaacaaggagagagtgaagatggtgatcttcccccccggcttccagcacaacctgctgtgcaagagccccaccctgctgatcaccgtgagagacttcctgagcaagcagtggagctag

SEQ ID NO: 17712 - DNA, 768 bp, Artificial Sequence
  Description of Artificial Sequence: Synthetic coding sequence
atgctgggcatctggcacaccgtgcccagctgcagaggcgaggacgccaagggcaaggactgctgctggtacgaggccgccctgagagacggcaaccccatcatcgtgtacctgcacggcagcgccgagcacagagccgccagccacagactgaagctggtgaaggtgctgagcgacggcggcttccacgtgctgagcgtggactacagaggcttcggcgacagcaccggcaagcccaccgaggagggcctgaccaccgacgccatctgcgtgtacgagtggaccaaggccagaagcggcatcacccccgtgtgcctgtggggccacagcctgggcaccggcgtggccaccaacgccgccaaggtgctggaggagaagggctgccccgtggacgccatcgtgctggaggcccccttcaccaacatgtgggtggccagcatcaactaccccctgctgaagatctacagaaacatccccggcttcctgagaaccctgatggacgccctgagaaaggacaagatcatcttccccaacgacgagaacgtgaagttcctgagcagccccctgctgatcctgcacggcgaggacgacagaaccgtgcccctggagtacggcaagaagctgtacgagatcgccagaaacgcctacagaaacaaggagagagtgaagatggtgatcttcccccccggcttccagcacaacctgctgtgcaagagccccaccctgctgatcaccgtgagagacttcctgagcaagcagtggagctag

SEQ ID NO: 17713 - DNA, 1410 bp, Artificial Sequence
  Description of Artificial Sequence: Synthetic coding sequence
atgtgcgtgatctgcttcgtgaaggccctggtgagagtgttcaagatctacctgaccgccagctacacctaccccttcagaggctggcccgtggccttcagatgggacgacgtgagagccgtgggcagaagcagcagccacagagccctgacctgcgccgccgccgccgccggcgtgtggctgctgagagacgagaccctgggcggcgacgccctgggcagaccccccagaggcgccagaagccaggcccagtgcctgctgcagcagctgagagagctgcccggccagctggccagctacgccctggcccacagcctgggcagatggctggtgtaccccggcagcgtgagcctgatgaccagagccctgctgcccctgctgcagcagggccaggagagactggtggagagataccacggcagaagagccaagctggtggcctgcgacggcaacgagatcgacaccatgttcatggacagaagacagcaccccggcagccacgtgcacggccccagactggtgatctgctgcgagggcaacgccggcttctacgagatgggctgcctgagcgcccccctggaggccggctacagcgtgctgggctggaaccaccccggcttcggcagcagcaccggcgtgcccttcccccagcacgacgccaacgccatggacgtggtggtggagtacgccctgcacagactgcacttcccccccgcccacctggtggtgtacggctggagcgtgggcggcttcaccgccacctgggccaccatgacctaccccgagctgggcgccctggtgctggacgccaccttcgacgacctggtgcccctggccctgaaggtgatgccccacagctggaagggcctggtggtgagaaccgtgagagagcacttcaacctgaacgtggccgagcagctgtgctgctaccccggccccgtgctgctgctgagaagaacccaggacgacgtggtgagcaccagcggcagactgagacccctgagccccggcgacgtggagggcaacagaggcaacgagctgctgctgagactgctggagcacagataccccgtggtgatggccagagagggcagagccgtggtgaccagatggctgagagccggcagcctggcccaggaggccgccttctacgccagatacagagtggacgaggactggtgcctggccctgctgagaagctacagagccagatgcgaggaggagctggagggcgaggaggccctgggcccccacggccccgccttcccctggctggtgggccagggcctgagcagcagaagaagaagaagactggccctgttcctggccagaaagcacctgaagaacgtggaggccacccacttcagccccctggagcccgaggagttccagctgccctggagactgtag

SEQ ID NO: 17714 - DNA, 1029 bp, Artificial Sequence
  Description of Artificial Sequence: Synthetic coding sequence
atggccgacgacctggagcagcagagccagggctggctgagcagctggctgcccacctggagacccaccagcatgagccagctgaagaacgtggaggccagaatcctgcagtgcctgcagaacaagttcctggccagatacgtgagcctgcccaaccagaacaagatctggaccgtgaccgtgagccccgagcagaacgacagaacccccctggtgatggtgcacggcttcggcggcggcgtgggcctgtggatcctgaacatggacagcctgagcgccagaagaaccctgcacaccttcgacctgctgggcttcggcagaagcagcagacccgccttccccagagaccccgagggcgccgaggacgagttcgtgaccagcatcgagacctggagagagaccatgggcatccccagcatgatcctgctgggccacagcctgggcggcttcctggccaccagctacagcatcaagtaccccgacagagtgaagcacctgatcctggtggacccctggggcttccccctgagacccaccaaccccagcgagatcagagccccccccgcctgggtgaaggccgtggccagcgtgctgggcagaagcaaccccctggccgtgctgagagtggccggcccctggggccccggcctggtgcagagattcagacccgacttcaagagaaagttcgccgacttcttcgaggacgacaccatcagcgagtacatctaccactgcaacgcccagaaccccagcggcgagaccgccttcaaggccatgatggagagcttcggctgggccagaagacccatgctggagagaatccacctgatcagaaaggacgtgcccatcaccatgatctacggcagcgacacctggatcgacaccagcaccggcaagaaggtgaagatgcagagacccgacagctacgtgagagacatggagatcaagggcgccagccaccacgtgtacgccgaccagccccacatcttcaacgccgtggtggaggagatctgcgacagcgtggactag

SEQ ID NO: 17715 - DNA, 1320 bp, Artificial Sequence
  Description of Artificial Sequence: Synthetic coding sequence
atgctgaccggcgtgaccgacggcatcttctgctgcctgctgggcaccccccccaacgccgtgggccccctggagagcgtggagagcagcgacggctacaccttcgtggaggtgaagcccggcagagtgctgagagtgaagcacgccggccccgcccccgccgccgccccccccccccccagcagcgccagcagcgacgccgcccagggcgacctgagcggcctggtgagatgccagagaagaatcaccgtgtacagaaacggcagactgctggtggagaacctgggcagagcccccagagccgacctgctgcacggccagaacggcagcggcgagccccccgccgccctggaggtggagctggccgaccccgccggcagcgacggcagactggcccccggcagcgccggcagcggcagcggcagcggcagcggcggcagaagaagaagagccagaagacccaagagaaccatccacatcgactgcgagaagagaatcaccagctgcaagggcgcccaggccgacgtggtgctgttcttcatccacggcgtgggcggcagcctggccatctggaaggagcagctggacttcttcgtgagactgggctacgaggtggtggcccccgacctggccggccacggcgccagcagcgccccccaggtggccgccgcctacaccttctacgccctggccgaggacatgagagccatcttcaagagatacgccaagaagagaaacgtgctgatcggccacagctacggcgtgagcttctgcaccttcctggcccacgagtaccccgacctggtgcacaaggtgatcatgatcaacggcggcggccccaccgccctggagcccagcttctgcagcatcttcaacatgcccacctgcgtgctgcactgcctgagcccctgcctggcctggagcttcctgaaggccggcttcgccagacagggcgccaaggagaagcagctgctgaaggagggcaacgccttcaacgtgagcagcttcgtgctgagagccatgatgagcggccagtactggcccgagggcgacgaggtgtaccacgccgagctgaccgtgcccgtgctgctggtgcacggcatgcacgacaagttcgtgcccgtggaggaggaccagagaatggccgagatcctgctgctggccttcctgaagctgatcgacgagggcagccacatggtgatgctggagtgccccgagaccgtgaacaccctgctgcacgagttcctgctgtgggagcccgagcccagccccaaggccctgcccgagcccctgcccgccccccccgaggacaagaagtag

SEQ ID NO: 17716 - DNA, 1158 bp, Artificial Sequence
  Description of Artificial Sequence: Synthetic coding sequence
atggccacccccccccccagcagcgccagcagcgacgccgcccagggcgacctgagcggcctggtgagatgccagagaagaatcaccgtgtacagaaacggcagactgctggtggagaacctgggcagagcccccagagccgacctgctgcacggccagaacggcagcggcgagccccccgccgccctggaggtggagctggccgaccccgccggcagcgacggcagactggcccccggcagcgccggcagcggcagcggcagcggcagcggcggcagaagaagaagagccagaagacccaagagaaccatccacatcgactgcgagaagagaatcaccagctgcaagggcgcccaggccgacgtggtgctgttcttcatccacggcgtgggcggcagcctggccatctggaaggagcagctggacttcttcgtgagactgggctacgaggtggtggcccccgacctggccggccacggcgccagcagcgccccccaggtggccgccgcctacaccttctacgccctggccgaggacatgagagccatcttcaagagatacgccaagaagagaaacgtgctgatcggccacagctacggcgtgagcttctgcaccttcctggcccacgagtaccccgacctggtgcacaaggtgatcatgatcaacggcggcggccccaccgccctggagcccagcttctgcagcatcttcaacatgcccacctgcgtgctgcactgcctgagcccctgcctggcctggagcttcctgaaggccggcttcgccagacagggcgccaaggagaagcagctgctgaaggagggcaacgccttcaacgtgagcagcttcgtgctgagagccatgatgagcggccagtactggcccgagggcgacgaggtgtaccacgccgagctgaccgtgcccgtgctgctggtgcacggcatgcacgacaagttcgtgcccgtggaggaggaccagagaatggccgagatcctgctgctggccttcctgaagctgatcgacgagggcagccacatggtgatgctggagtgccccgagaccgtgaacaccctgctgcacgagttcctgctgtgggagcccgagcccagccccaaggccctgcccgagcccctgcccgccccccccgaggacaagaagtag

SEQ ID NO: 17717 - DNA, 1851 bp, Artificial Sequence
  Description of Artificial Sequence: Synthetic coding sequence
atggagctgagaacccccggcaccaagtggagcccccagggcatcggcagcctgagaagagtggtgtgggactacagcacccccgagatcagcctgttcagcgaggagggcctgaagggcgagcaggtgaagctgaccgaggccctgaagaacagccagggcctggagaagcccctgcaggtggccagcgccaccgtgagcgccggcctgtggctgctgtaccccaagcccctgttcgaggacaccccctacatcctggagcccggcgagtaccccaccagcgaggcctggggcaccagcgaccccagcgtgggcagcctgaagcccatgagactgggctgccccagcgtggagaagcccggcgagcccagagccgtggtgtacgaggcccccggcttccagggcagaagctgggaggtgagcagagacatctacaacctgcagcagcccgaggacagccagagcccccacctggccagcgtgggcagcctgagagtgctgggcggctgctgggtgggctacgagaaggagggcttcagaggccaccagtacctgctggaggagggcgagtaccccgactggagccactggggcggctacgacgagctgctgaccagcctgagagtgatcagaaccgacttcggcgaccccgccgtggtgctgttcgaggccatggacttcgagggccacggcgtggaggtgagcaaggccctgcccgacgtggagctggtgcagcacggccccagcacccaggccatccacgtgctgagcggcgtgtgggtggcctaccaggaggtgggcttcagcggcgagcagtacgtgctggagaagggcgtgtacagaaactgcgaggactggggcgccggcaacagcaccctggccagcctgcagcccgtgctgcaggtgggcgagcacgacctgcacttcgtgagcaagatccagctgttcagcagacccgacttcctgggcgaccacttcagcttcgaggacgaccaggccgccctgcccgccagcttcagaccccagagctgcagagtgcacggcggcagctggatcctgttcgacgagaccaacttcgagggcgaccagcacatcctgagcgagggcgagttccccaccctgaccgccatgggctgcctggccagcaccgtgctgggcagcctgcagaaggtgagcctgcacttcagcgagcccagcatcttcctgtacggcctggagtgcttcgagggcaaggagatcgagctgagcagagaggtgagaagcctgcaggccgagggcttcaacaaccacgtgctgagcgtgagaatcaagggcggcatctgggtgctgtgcgagcacagcgacttcagaggcagacagtggctggtgggcagctgcgagatcaccaactggctgacctacagcggcacccagagagtgggcagcctgtaccccatcaagcagagaagagtgtacttcagactgtggaacgccgccctgggcggcttcctggccgtgcccgaccacgtggaggacatgaaggccggcagagtggtggtggccgacccccaggccggcggcagctgcatctggtactacgaggacggcctgctgaagaaccagatggcccccaccatgagcctgcaggtgatcggcccccccagccccggcagcaaggtggtgctgtgggccgagagcagactgcccagacagacctggagcatcagcgagagcggccacatctgcagccagatgttcgagggccagatcctggacgtgaagggcggcagaggctacgacagagaccacgtggtgctgtgggagcccgacgaggacagagccagccagatctggaccatccacgtgctgtag

SEQ ID NO: 17718 - DNA, 282 bp, Artificial Sequence
  Description of Artificial Sequence: Synthetic coding sequence
atggaggaggccggcggccccatggccagagccaaggccagagtggacggccccgtggacccccccgccgccaccgtgctgcccatggtgagaagcgagcacgtgaccgtgcccggccagccccccgcccccagcaccaccagaagaaaggacgtgcccagccccggcgtggacagagtgagccccagccccggcggcacccccgcccccgtgcccaccggcgccgaggccagcaccgagagccagctggtgagcgaccccaccgagggcaagacctgctag

SEQ ID NO: 17719 - DNA, 2364 bp, Artificial Sequence
  Description of Artificial Sequence: Synthetic coding sequence
atgatgaagaagcacgtggccggcaccaagggcccccacagcgagctgggcctggagctgcagggcggcagcagacccaccagcagactgggcggcagcctgctgttcggcagcctggtgcccaccgccaaggaggccagcacccccgagcccctgggcaccaagctgagcgccctgctgccccacggcgcccccggcctgagaaaggtgcccggccagctgcccctgctgtgcagcgagagaagcagccccaccgagaagctggcctgcagcctgcccctggagggctggagccccgccctgaagacccagggcaagctgaacaccagacccggcaaggtgatcttcttcagcgagagcggctgccagggcagcggcagagaggtgtggggcgacatcgtggacgccagcggctgggcccccgtggccagcatcagagtggtgagaggctgctgggtgctgtacgaggagcccgagttcagaggccagaagctggtgctgcccgagggcgacatggagctgagaacccccggcaccaagtggagcccccagggcatcggcagcctgagaagagtggtgtgggactacagcacccccgagatcagcctgttcagcgaggagggcctgaagggcgagcaggtgaagctgaccgaggccctgaagaacagccagggcctggagaagcccctgcaggtggccagcgccaccgtgagcgccggcctgtggctgctgtaccccaagcccctgttcgaggacaccccctacatcctggagcccggcgagtaccccaccagcgaggcctggggcaccagcgaccccagcgtgggcagcctgaagcccatgagactgggctgccccagcgtggagaagcccggcgagcccagagccgtggtgtacgaggcccccggcttccagggcagaagctgggaggtgagcagagacatctacaacctgcagcagcccgaggacagccagagcccccacctggccagcgtgggcagcctgagagtgctgggcggctgctgggtgggctacgagaaggagggcttcagaggccaccagtacctgctggaggagggcgagtaccccgactggagccactggggcggctacgacgagctgctgaccagcctgagagtgatcagaaccgacttcggcgaccccgccgtggtgctgttcgaggccatggacttcgagggccacggcgtggaggtgagcaaggccctgcccgacgtggagctggtgcagcacggccccagcacccaggccatccacgtgctgagcggcgtgtgggtggcctaccaggaggtgggcttcagcggcgagcagtacgtgctggagaagggcgtgtacagaaactgcgaggactggggcgccggcaacagcaccctggccagcctgcagcccgtgctgcaggtgggcgagcacgacctgcacttcgtgagcaagatccagctgttcagcagacccgacttcctgggcgaccacttcagcttcgaggacgaccaggccgccctgcccgccagcttcagaccccagagctgcagagtgcacggcggcagctggatcctgttcgacgagaccaacttcgagggcgaccagcacatcctgagcgagggcgagttccccaccctgaccgccatgggctgcctggccagcaccgtgctgggcagcctgcagaaggtgagcctgcacttcagcgagcccagcatcttcctgtacggcctggagtgcttcgagggcaaggagatcgagctgagcagagaggtgagaagcctgcaggccgagggcttcaacaaccacgtgctgagcgtgagaatcaagggcggcatctgggtgctgtgcgagcacagcgacttcagaggcagacagtggctggtgggcagctgcgagatcaccaactggctgacctacagcggcacccagagagtgggcagcctgtaccccatcaagcagagaagagtgtacttcagactgtggaacgccgccctgggcggcttcctggccgtgcccgaccacgtggaggacatgaaggccggcagagtggtggtggccgacccccaggccggcggcagctgcatctggtactacgaggacggcctgctgaagaaccagatggcccccaccatgagcctgcaggtgatcggcccccccagccccggcagcaaggtggtgctgtgggccgagagcagactgcccagacagacctggagcatcagcgagagcggccacatctgcagccagatgttcgagggccagatcctggacgtgaagggcggcagaggctacgacagagaccacgtggtgctgtgggagcccgacgaggacagagccagccagatctggaccatccacgtgctgtag

SEQ ID NO: 17720 - DNA, 1224 bp, Artificial Sequence
  Description of Artificial Sequence: Synthetic coding sequence
atggaggaggccggcggccccatggccagagccaaggccagagtggtgagcgccaccctgacctggagacagagaccccccacccaggaggagatcaagcacggcttccacaaggtgagcctggtgagcggcgcccagatggaggccccccagaaggagatgttcgagttcagcagaagagaggaggtggaggtgaacggcttcgccacccaggaggaggagaccgtgaactgccagggccccagagacaccgccggcagcaagaacttccagagccacggccccatcttcagcaagaagtacatccccccccccaaggagaagagacccgagggcagactgaaggaggccgtggaccagagcgacggcagcagacaggcccccagaaccgagcccccctgcgtgggcgccatggccagaaccgagctgctggtgcccctgcccggccccagagagcccagcccccaccccggcgtgggcctgaccagcggcagcagcagaagcctggaggagtacagagtgaccagaaccgtgagaaccaccaccgtggtgggcggccacgtggacagaagaatgagcagcagcgtgaccgtgagacccgtgagcagcggcgaggccctgcccagaggcagacaggtgagcagaatggtgccccccgtggtggtgggcagcccccccggcagccccagcagaagccaggccgtgaaggtgctgagcaacctggtgcccgccggccacagcccccccgccagccacctgcccagacccaccgccggcggccccagaagcaccggcctgggcagcaccgtgggcgccgccctgagacagctgcccgagaccggcaccgccgagctgaaggacagcagcgccctggccagcaccggcatccccgccagcgcccacctgcccaagaaccaggacgcccccgccgcctgccccgacagagaccagggcagagcccccgacgccagagcctgcgagctgtggcaggtgctgggcgcccccagcagcaccgagctgcccctgcagaccagccagggccaggccagcgtgcccagcagccccagactggagacccacgtgcccagccccggcctgacccaccccgccaagcagcccgtggtgcccacccaccccggcgccagactgacccccctggtgctgccccccaagaagagaaccggcccctggacccccctgctgccccccagctgcccctggtag

SEQ ID NO: 17721 - DNA, 1128 bp, Artificial Sequence
  Description of Artificial Sequence: Synthetic coding sequence
atggaggaggagatcgccgccctggtgatcgacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtggcccccgaggagcaccccgtgctgctgaccgaggcccccctgaaccccaaggccaacagagagaagatgacccagatcatgttcgagaccttcaacacccccgccatgtacgtggccatccaggccgtgctgagcctgtacgccagcggcagaaccaccggcatcgtgatggacagcggcgacggcgtgacccacaccgtgcccatctacgagggctacgccctgccccacgccatcctgagactggacctggccggcagagacctgaccgactacctgatgaagatcctgaccgagagaggctacagcttcaccaccaccgccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagcccagcttcctgggcatggagagctgcggcatccacgagaccaccttcaacagcatcatgaagtgcgacgtggacatcagaaaggacctgtacgccaacaccgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgagagcggccccagcatcgtgcacagaaagtgcttctag

SEQ ID NO: 17722 - DNA, 1128 bp, Artificial Sequence; identical to SEQ ID NO: 17721
  Description of Artificial Sequence: Synthetic coding sequence

SEQ ID NO: 17723 - DNA, 1026 bp, Artificial Sequence
  Description of Artificial Sequence: Synthetic coding sequence
atgggcaccgagaaggagagccccgagcccgactgccagaagcagttccaggccgccgtgagcgtgatccagaacctgcccaagaacggcagctacagacccagctacgaggagatgctgagattctacagctactacaagcaggccaccatgggcccctgcctggtgcccagacccggcttctgggaccccatcggcagatacaagtgggacgcctggaacagcctgggcaagatgagcagagaggaggccatgagcgcctacatcaccgagatgaagctggtggcccagaaggtgatcgacaccgtgcccctgggcgaggtggccgaggacatgttcggctacttcgagcccctgtaccaggtgatccccgacatgcccagaccccccgagaccttcctgagaagagtgaccggctggaaggagcaggtggtgaacggcgacgtgggcgccgtgagcgagcccccctgcctgcccaaggagcccgccccccccagccccgccagcctgtgggccgtgaccctgcccacccccccccagagccccatccaccccggcacctggacccccagattcagcgtgatcccctggagcagctggagcctgagctggttcggccagagcagcggccagcacctggaggagagcgtgatccccggcaccgccccctgccccccccagagaaagagaggctgcggcgccgccagaagaggccccagaagctggacctgcggctgctggggccagttcgagcactacagaagagcctgcagaagatgcagaagaggctgcagagcctggagagcctgccccggccccctgagcagaggcagaagccccggccccgtgctgggccacggccccctgggcagcagaggccccagatgcagcagcagcagctgcggccccagcagcagcagcggcagcagcgagtgcttcggccccaagagaggcgactgccagtggagaggcctgtgcagccagctgagactgagctgctgcgccctgagcctgcccagagtgtag

SEQ ID NO: 17724 - DNA, 807 bp, Artificial Sequence
  Description of Artificial Sequence: Synthetic coding sequence
atgggcaccgagaaggagagccccgagcccgactgccagaagcagttccaggccgccgtgagcgtgatccagaacctgcccaagaacggcagctacagacccagctacgaggagatgctgagattctacagctactacaagcaggccaccatgggcccctgcctggtgcccagacccggcttctgggaccccatcggcagatacaagtgggacgcctggaacagcctgggcaagatgagcagagaggaggccatgagcgcctacatcaccgagatgaagctggtggcccagaaggtgatcgacaccgtgcccctgggcgaggtggccgaggacatgttcggctacttcgagcccctgtaccaggtgatccccgacatgcccagaccccccgagaccttcctgagaagagtgaccggctggaaggagcaggtggtgaacggcgacgtgggcgccgtgagcgagcccccctgcctgcccaaggagcccgccccccccagccccgagagccacagccccagagacctggacagcgaggtgttctgcgacagcctggagcagctggagcccgagctgagcagcggccagcacctggaggagagcgtgatccccggcaccgccccctgccccccccagagaaagagaggctgcggcgccgccagaagaggccccagaagctggacctgcggctgctggggccagttcgagcactacagaagagcctgcagaagatgcagaagaggctgcagagcctggagagcctgccccggccccctgagcagcctgaccctgagcgtgagactggagtag

SEQ ID NO: 17725 - DNA, 918 bp, Artificial Sequence
  Description of Artificial Sequence: Synthetic coding sequence
atgggcaccgagaaggagagccccgagcccgactgccagaagcagttccaggccgccgtgagcgtgatccagaacctgcccaagaacggcagctacagacccagctacgaggagatgctgagattctacagctactacaagcaggccaccatgggcccctgcctggtgcccagacccggcttctgggaccccatcggcagatacaagtgggacgcctggaacagcctgggcaagatgagcagagaggaggccatgagcgcctacatcaccgagatgaagctggtggcccagaaggtgatcgacaccgtgcccctgggcgaggtggccgaggacatgttcggctacttcgagcccctgtaccaggtgatccccgacatgcccagaccccccgagaccttcctgagaagagtgaccggctggaaggagcaggtggtgaacggcgacgtgggcgccgtgagcgagcccccctgcctgcccaaggagcccgccccccccagccccgagagccacagccccagagacctggacagcgaggtgttctgcgacagcctggagcagctggagcccgagctggtgtggaccgagcagagagccgccagcggcggcaagagagaccccagaaacagccccgtgccccccaccaagaaggagggcctgagaggcagcccccccggcccccaggagctggacgtgtggctgctgggcaccgtgagagccctgcaggagagcatgcaggaggtgcaggccagagtgcagagcctggagagcatgcccagaccccccgagcagagaccccagcccagacccagcgccagaccctggcccctgggcctgcccggccccgccctgctgttcttcctgctgtggcccttcgtggtgcagtggctgttcagaatgttcagaacccagaagagatag

SEQ ID NO: 17726 - DNA, 1026 bp, Artificial Sequence; identical to SEQ ID NO: 17723
  Description of Artificial Sequence: Synthetic coding sequence

SEQ ID NO: 17727 - DNA, 267 bp, Artificial Sequence
  Description of Artificial Sequence: Synthetic coding sequence
atggccctgcaggccgacttcgacagagccgccgaggacgtgagaaagctgaaggccagacccgacgacggcgagctgaaggagctgtacggcctgtacaagcaggccatcgtgggcgacatcaacatcgcctgccccggcatgctggacctgaagggcaaggccaagtgggaggcctggaacctgaagaagggcctgagcaccgaggacgccaccagcgcctacatcagcaaggccaaggagctgatcgagaagtacggcatctag

SEQ ID NO: 17728 - DNA, 3180 bp, Artificial Sequence
  Description of Artificial Sequence: Synthetic coding sequence
atgtgcgtgagaagctgcttccagagccccagactgcagtgggtgtggagaaccgccttcctgaagcacacccagagaagacaccagggcagccacagatggacccacctgggcggcagcacctacagagccgtgatcttcgacatgggcggcgtgctgatccccagccccggcagagtggccgccgagtgggaggtgcagaacagaatccccagcggcaccatcctgaaggccctgatggagggcggcgagaacggcccctggatgagattcatgagagccgagatcaccgccgagggcttcctgagagagttcggcagactgtgcagcgagatgctgaagaccagcgtgcccgtggacagcttcttcagcctgctgaccagcgagagagtggccaagcagttccccgtgatgaccgaggccatcacccagatcagagccaagggcctgcagaccgccgtgctgagcaacaacttctacctgcccaaccagaagagcttcctgcccctggacagaaagcagttcgacgtgatcgtggagagctgcatggagggcatctgcaagcccgaccccagaatctacaagctgtgcctggagcagctgggcctgcagcccagcgagagcatcttcctggacgacctgggcaccaacctgaaggaggccgccagactgggcatccacaccatcaaggtgaacgaccccgagaccgccgtgaaggagctggaggccctgctgggcttcaccctgagagtgggcgtgcccaacaccagacccgtgaagaagaccatggagatccccaaggacagcctgcagaagtacctgaaggacctgctgggcatccagaccaccggccccctggagctgctgcagttcgaccacggccagagcaaccccacctactacatcagactggccaacagagacctggtgctgagaaagaagccccccggcaccctgctgcccagcgcccacgccatcgagagagagttcagaatcatgaaggccctggccaacgccggcgtgcccgtgcccaacgtgctggacctgtgcgaggacagcagcgtgatcggcacccccttctacgtgatggagtactgccccggcctgatctacaaggaccccagcctgcccggcctggagcccagccacagaagagccatctacaccgccatgaacaccgtgctgtgcaagatccacagcgtggacctgcaggccgtgggcctggaggactacggcaagcagggcgactacatccccagacaggtgagaacctgggtgaagcagtacagagccagcgagaccagcaccatccccgccatggagagactgatcgagtggctgcccctgcacctgcccagacagcagagaaccaccgtggtgcacggcgacttcagactggacaacctggtgttccaccccgaggagcccgaggtgctggccgtgctggactgggagctgagcaccctgggcgaccccctggccgacgtggcctacagctgcctggcccactacctgcccagcagcttccccgtgctgagaggcatcaacgactgcgacctgacccagctgggcatccccgccgccgaggagtacttcagaatgtactgcctgcagatgggcctgccccccaccgagaactggaacttctacatggccttcagcttcttcagagtggccgccatcctgcagggcgtgtacaagagaagcctgaccggccaggccagcagcacctacgccgagcagaccggcaagctgaccgagttcgtgagcaacctggcctgggacttcgccgtgaaggagggcttcagagtgttcaaggagatgcccttcaccaaccccctgaccagaagctaccacacctgggccagaccccagagccagtggtgccccaccggcagcagaagctacagcagcgtgcccgaggccagccccgcccacaccagcagaggcggcctggtgatcagccccgagagcctgagcccccccgtgagagagctgtaccacagactgaagcacttcatggagcagagagtgtaccccgccgagcccgagctgcagagccaccaggccagcgccgccagatggagccccagccccctgatcgaggacctgaaggagaaggccaaggccgagggcctgtggaacctgttcctgcccctggaggccgaccccgagaagaagtacggcgccggcctgaccaacgtggagtacgcccacctgtgcgagctgatgggcaccagcctgtacgcccccgaggtgtgcaactgcagcgcccccgacaccggcaacatggagctgctggtgagatacggcaccgaggcccagaaggccagatggctgatccccctgctggagggcaaggccagaagctgcttcgccatgaccgagccccaggtggccagcagcgacgccaccaacatcgaggccagcatcagagaggaggacagcttctacgtgatcaacggccacaagtggtggatcaccggcatcctggaccccagatgccagctgtgcgtgttcatgggcaagaccgacccccacgcccccagacacagacagcagagcgtgctgctggtgcccatggacacccccggcatcaagatcatcagacccctgaccgtgtacggcctggaggacgcccccggcggccacggcgaggtgagattcgagcacgtgagagtgcccaaggagaacatggtgctgggccccggcagaggcttcgagatcgcccagggcagactgggccccggcagaatccaccactgcatgagactgatcggcttcagcgagagagccctggccctgatgaaggccagagtgaagagcagactggccttcggcaagcccctggtggagcagggcaccgtgctggccgacatcgcccagagcagagtggagatcgagcaggccagactgctggtgctgagagccgcccacctgatggacctggccggcaacaaggccgccgccctggacatcgccatgatcaagatggtggcccccagcatggccagcagagtgatcgacagagccatccaggccttcggcgccgccggcctgagcagcgactaccccctggcccagttcttcacctgggccagagccctgagattcgccgacggccccgacgaggtgcacagagccaccgtggccaagctggagctgaagcacagaatctag

SEQ ID NO: 17729 - DNA, 1479 bp, Artificial Sequence
  Description of Artificial Sequence: Synthetic coding sequence
atgctggagtacctgagcctgaccttcctgatcagcgtgaagatccagggcgactacatccccagacaggtgagaacctgggtgaagcagtacagagccagcgagaccagcaccatccccgccatggagagactgatcgagtggctgcccctgcacctgcccagacagcagagaaccaccgtggtgcacggcgacttcagactggacaacctggtgttccaccccgaggagcccgaggtgctggccgtgctggactgggagctgagcaccctgggcgaccccctggccgacgtggcctacagctgcctggcccactacctgcccagcagcttccccgtgctgagaggcatcaacgactgcgacctgacccagctgggcatccccgccgccgaggagtacttcagaatgtactgcctgcagatgggcctgccccccaccgagaactggaacttctacatggccttcagcttcttcagagtggccgccatcctgcagggcgtgtacaagagaagcctgaccggccaggccagcagcacctacgccgagcagaccggcaagctgaccgagttcgtgagcaacctggcctgggacttcgccgtgaaggagggcttcagagtgttcaaggagatgcccttcaccaaccccctgaccagaagctaccacacctgggccagaccccagagccagtggtgccccaccggcagcagaagctacagcagcgtgcccgaggccagccccgcccacaccagcagaggcggcctggtgatcagccccgagagcctgagcccccccgtgagagagctgtaccacagactgaagcacttcatggagcagagagtgtaccccgccgagcccgagctgcagagccaccaggccagcgccgccagatggagccccagccccctgatcgaggacctgaaggagaaggccaaggccgagggcctgtggaacctgttcctgcccctggaggccgaccccgagaagaagtacggcgccggcctgaccaacgtggagtacgcccacctgtgcgagctgatgggcaccagcctgtacgcccccgaggtgtgcaactgcagcgcccccgacaccggcaacatggagctgctggtgagatacggcaccgaggcccagaaggccagatggctgatccccctgctggagggcaaggccagaagctgcttcgccatgaccgagccccaggtggccagcagcgacgccaccaacatcgaggccagcatcagagaggaggacagcttctacgtgatcaacggccacaagtggtggatcaccggcatcctggaccccagatgccagctgtgcgtgttcatgggcaagaccgacccccacgcccccagacacagacagcagagcgtgctgctggtgcccatggacacccccggcatcaagatcatcagacccctgaccgtgtacggcctggaggacgcccccggctgcttcctgcccagcttcagcctgtag

SEQ ID NO: 17730 - DNA, 2673 bp, Artificial Sequence
  Description of Artificial Sequence: Synthetic coding sequence
atgtgcgtgagaagctgcttccagagccccagactgcagtgggtgtggagaaccgccttcctgaagcacacccagagaagacaccagggcagccacagatggacccacctgggcggcagcacctacagagccgtgatcttcgacatgggcggcgtgctgatccccagccccggcagagtggccgccgagtgggaggtgcagaacagaatccccagcggcaccatcctgaaggccctgatggagggcggcgagaacggcccctggatgagattcatgagagccgagatcaccgccgagggcttcctgagagagttcggcagactgtgcagcgagatgctgaagaccagcgtgcccgtggacagcttcttcagcctgctgaccagcgagagagtggccaagcagttccccgtgatgaccgaggccatcacccagatcagagccaagggcctgcagaccgccgtgctgagcaacaacttctacctgcccaaccagaagagcttcctgcccctggacagaaagcagttcgacgtgatcgtggagagctgcatggagggcatctgcaagcccgaccccagaatctacaagctgtgcctggagcagctgggcctgcagcccagcgagagcatcttcctggacgacctgggcaccaacctgaaggaggccgccagactgggcatccacaccatcaaggtgaacgaccccgagaccgccgtgaaggagctggaggccctgctgggcttcaccctgagagtgggcgtgcccaacaccagacccgtgaagaagaccatggagatccccaaggacagcctgcagaagtacctgaaggacctgctgggcatccagaccaccggccccctggagctgctgcagttcgaccacggccagagcaaccccacctactacatcagactggccaacagagacctggtgctgagaaagaagccccccggcaccctgctgcccagcgcccacgccatcgagagagagttcagaatcatgaaggccctggccaacgccggcgtgcccgtgcccaacgtgctggacctgtgcgaggacagcagcgtgatcggcacccccttctacgtgatggagtactgccccggcctgatctacaaggaccccagcctgcccggcctggagcccagccacagaagagccatctacaccgccatgaacaccgtgctgtgcaagatccacagcgtggacctgcaggccgtgggcctggaggactacggcaagcagggcgactacatccccagacaggtgagaacctgggtgaagcagtacagagccagcgagaccagcaccatccccgccatggagagactgatcgagtggctgcccctgcacctgcccagacagcagagaaccaccgtggtgcacggcgacttcagactggacaacctggtgttccaccccgaggagcccgaggtgctggccgtgctggactgggagctgagcaccctgggcgaccccctggccgacgtggcctacagctgcctggcccactacctgcccagcagcttccccgtgctgagaggcatcaacgactgcgacctgacccagctgggcatccccgccgccgaggagtacttcagaatgtactgcctgcagatgggcctgccccccaccgagaactggaacttctacatggccttcagcttcttcagagtggccgccatcctgcagggcgtgtacaagagaagcctgaccggccaggccagcagcacctacgccgagcagaccggcaagctgaccgagttcgtgagcaacctggcctgggacttcgccgtgaaggagggcttcagagtgttcaaggagatgcccttcaccaaccccctgaccagaagctaccacacctgggccagaccccagagccagtggtgccccaccggcagcagaagctacagcagcgtgcccgaggccagccccgcccacaccagcagaggcggcctggtgatcagccccgagagcctgagcccccccgtgagagagctgtaccacagactgaagcacttcatggagcagagagtgtaccccgccgagcccgagctgcagagccaccaggccagcgccgccagatggagccccagccccctgatcgaggacctgaaggagaaggccaaggccgagggcctgtggaacctgttcctgcccctggaggccgaccccgagaagaagtacggcgccggcctgaccaacgtggagtacgcccacctgtgcgagctgatgggcaccagcctgtacgcccccgaggtgtgcaactgcagcgcccccgacaccggcaacatggagctgctggtgagatacggcaccgaggcccagaaggccagatggctgatccccctgctggagggcaaggccagaagctgcttcgccatgaccgagccccaggtggccagcagcgacgccaccaacatcgaggccagcatcagagaggaggacagcttctacgtgatcaacggccacaagtggtggatcaccggcatcctggaccccagatgccagctgtgcgtgttcatgggcaagaccgacccccacgcccccagacacagacagcagagcgtgctgctggtgcccatggacacccccggcatcaagatcatcagacccctgaccgtgtacggcctggaggacgcccccggctgcttcctgcccagcttcagcctgtag

SEQ ID NO: 17731 - DNA, 3273 bp, Artificial Sequence
  Description of Artificial Sequence: Synthetic coding sequence
atgtgcgtgagaagctgcttccagagccccagactgcagtgggtgtggagaaccgccttcctgaagcacacccagagaagacaccagggcagccacagatggacccacctgggcggcagcacctacagagccgtgatcttcgacatgggcggcgtgctgatccccagccccggcagagtggccgccgagtgggaggtgcagaacagaatccccagcggcaccatcctgaaggccctgatggagggcggcgagaacggcccctggatgagattcatgagagccgagatcaccgccgagggcttcctgagagagttcggcagactgtgcagcgagatgctgaagaccagcgtgcccgtggacagcttcttcagcctgctgaccagcgagagagtggccaagcagttccccgtgatgaccgaggccatcacccagatcagagccaagggcctgcagaccgccgtgctgagcaacaacttctacctgcccaaccagaagagcttcctgcccctggacagaaagcagttcgacgtgatcgtggagagctgcatggagggcatctgcaagcccgaccccagaatctacaagctgtgcctggagcagctgggcctgcagcccagcgagagcatcttcctggacgacctgggcaccaacctgaaggaggccgccagactgggcatccacaccatcaagagacagggcttcgccgtgctgcccaagctggtgagcaacagctgggcccaggccatctaccccccctacccccccaaggtggtgagactgcaggtgaacgaccccgagaccgccgtgaaggagctggaggccctgctgggcttcaccctgagagtgggcgtgcccaacaccagacccgtgaagaagaccatggagatccccaaggacagcctgcagaagtacctgaaggacctgctgggcatccagaccaccggccccctggagctgctgcagttcgaccacggccagagcaaccccacctactacatcagactggccaacagagacctggtgctgagaaagaagccccccggcaccctgctgcccagcgcccacgccatcgagagagagttcagaatcatgaaggccctggccaacgccggcgtgcccgtgcccaacgtgctggacctgtgcgaggacagcagcgtgatcggcacccccttctacgtgatggagtactgccccggcctgatctacaaggaccccagcctgcccggcctggagcccagccacagaagagccatctacaccgccatgaacaccgtgctgtgcaagatccacagcgtggacctgcaggccgtgggcctggaggactacggcaagcagggcgactacatccccagacaggtgagaacctgggtgaagcagtacagagccagcgagaccagcaccatccccgccatggagagactgatcgagtggctgcccctgcacctgcccagacagcagagaaccaccgtggtgcacggcgacttcagactggacaacctggtgttccaccccgaggagcccgaggtgctggccgtgctggactgggagctgagcaccctgggcgaccccctggccgacgtggcctacagctgcctggcccactacctgcccagcagcttccccgtgctgagaggcatcaacgactgcgacctgacccagctgggcatccccgccgccgaggagtacttcagaatgtactgcctgcagatgggcctgccccccaccgagaactggaacttctacatggccttcagcttcttcagagtggccgccatcctgcagggcgtgtacaagagaagcctgaccggccaggccagcagcacctacgccgagcagaccggcaagctgaccgagttcgtgagcaacctggcctgggacttcgccgtgaaggagggcttcagagtgttcaaggagatgcccttcaccaaccccctgaccagaagctaccacacctgggccagaccccagagccagtggtgccccaccggcagcagaagctacagcagcgtgcccgaggccagccccgcccacaccagcagaggcggcctggtgatcagccccgagagcctgagcccccccgtgagagagctgtaccacagactgaagcacttcatggagcagagagtgtaccccgccgagcccgagctgcagagccaccaggccagcgccgccagatggagccccagccccctgatcgaggacctgaaggagaaggccaaggccgagggcctgtggaacctgttcctgcccctggaggccgaccccgagaagaagtacggcgccggcctgaccaacgtggagtacgcccacctgtgcgagctgatgggcaccagcctgtacgcccccgaggtgtgcaactgcagcgcccccgacaccggcaacatggagctgctggtgagatacggcaccgaggcccagaaggccagatggctgatccccctgctggagggcaaggccagaagctgcttcgccatgaccgagccccaggtggccagcagcgacgccaccaacatcgaggccagcatcagagaggaggacagcttctacgtgatcaacggccacaagtggtggatcaccggcatcctggaccccagatgccagctgtgcgtgttcatgggcaagaccgacccccacgcccccagacacagacagcagagcgtgctgctggtgcccatggacacccccggcatcaagatcatcagacccctgaccgtgtacggcctggaggacgcccccggcggccacggcgaggtgagattcgagcacgtgagagtgcccaaggagaacatggtgctgggccccggcagaggcttcgagatcgcccagggcagactgggccccggcagaatccaccactgcatgagactgatcggcttcagcgagagagccctggccctgatgaaggccagagtgaagagcagactggccttcggcaagcccctggtggagcagggcaccgtgctggccgacatcgcccagagcagagtggagatcgagcaggccagactgctggtgctgagagccgcccacctgatggacctggccggcaacaaggccgccgccctggacatcgccatgatcaagatggtggcccccagcatggccagcagagtgatcgacagagccatccaggccttcggcgccgccggcctgagcagcgactaccccctggcccagttcttcacctgggccagagccctgagattcgccgacggccccgacgaggtgcacagagccaccgtggccaagctggagctgaagcacagaatctag

SEQ ID NO: 17732 - DNA, 291 bp, Artificial Sequence
  Description of Artificial Sequence: Synthetic coding sequence
atgtgcgtgagaagctgcttccagagccccagactgcagtgggtgtggagaaccgccttcctgaagcacacccagagaagacaccagggcagccacagatggacccacctgggcggcagcacctacagagccgtgatcttcgacatgggcggcgtgctgatccccagccccggcagagtggccgccgagtgggaggtgcagaacagaatccccagcggcaccatcctgaaggccctgatggagggcggcgagaacggcccctggatgagattcatgagagccgagatctag

SEQ ID NO: 17733 - DNA, 3312 bp, Artificial Sequence
  Description of Artificial Sequence: Synthetic coding sequence
atggcccccgcctgccagatcctgagatgggccctggccctgggcctgggcctgatgttcgaggtgacccacgccttcagaagccaggacgagttcctgagcagcctggagagctacgagatcgccttccccaccagagtggaccacaacggcgccctgctggccttcagcccccccccccccagaagacagagaagaggcaccggcgccaccgccgagagcagactgttctacaaggtggccagccccagcacccacttcctgctgaacctgaccagaagcagcagactgctggccggccacgtgagcgtggagtactggaccagagagggcctggcctggcagagagccgccagaccccactgcctgtacgccggccacctgcagggccaggccagcagcagccacgtggccatcagcacctgcggcggcctgcacggcctgatcgtggccgacgaggaggagtacctgatcgagcccctgcacggcggccccaagggcagcagaagccccgaggagagcggcccccacgtggtgtacaagagaagcagcctgagacacccccacctggacaccgcctgcggcgtgagagacgagaagccctggaagggcagaccctggtggctgagaaccctgaagcccccccccgccagacccctgggcaacgagaccgagagaggccagcccggcctgaagagaagcgtgagcagagagagatacgtggagaccctggtggtggccgacaagatgatggtggcctaccacggcagaagagacgtggagcagtacgtgctggccatcatgaacatcgtggccaagctgttccaggacagcagcctgggcagcaccgtgaacatcctggtgaccagactgatcctgctgaccgaggaccagcccaccctggagatcacccaccacgccggcaagagcctggacagcttctgcaagtggcagaagagcatcgtgaaccacagcggccacggcaacgccatccccgagaacggcgtggccaaccacgacaccgccgtgctgatcaccagatacgacatctgcatctacaagaacaagccctgcggcaccctgggcctggcccccgtgggcggcatgtgcgagagagagagaagctgcagcgtgaacgaggacatcggcctggccaccgccttcaccatcgcccacgagatcggccacaccttcggcatgaaccacgacggcgtgggcaacagctgcggcgccagaggccaggaccccgccaagctgatggccgcccacatcaccatgaagaccaaccccttcgtgtggagcagctgcagcagagactacatcaccagcttcctggacagcggcctgggcctgtgcctgaacaacagaccccccagacaggacttcgtgtaccccaccgtggcccccggccaggcctacgacgccgacgagcagtgcagattccagcacggcgtgaagagcagacagtgcaagtacggcgaggtgtgcagcgagctgtggtgcctgagcaagagcaacagatgcatcaccaacagcatccccgccgccgagggcaccctgtgccagacccacaccatcgacaagggctggtgctacaagagagtgtgcgtgcccttcggcagcagacccgagggcgtggacggcgcctggggcccctggaccccctggggcgactgcagcagaacctgcggcggcggcgtgagcagcagcagcagacactgcgacagccccagacccaccatcggcggcaagtactgcctgggcgagagaagaagacacagaagctgcaacaccgacgactgcccccccggcagccaggacttcagagaggtgcagtgcagcgagttcgacagcatccccttcagaggcaagttctacaagtggaagacctacagaggcggcggcgtgaaggcctgcagcctgacctgcctggccgagggcttcaacttctacaccgagagagccgccgccgtggtggacggcaccccctgcagacccgacaccgtggacatctgcgtgagcggcgagtgcaagcacgtgggctgcgacagagtgctgggcagcgacctgagagaggacaagtgcagagtgtgcggcggcgacggcagcgcctgcgagaccatcgagggcgtgttcagccccgccagccccggcgccggctacgaggacgtggtgtggatccccaagggcagcgtgcacatcttcatccaggacctgaacctgagcctgagccacctggccctgaagggcgaccaggagagcctgctgctggagggcctgcccggcaccccccagccccacagactgcccctggccggcaccaccttccagctgagacagggccccgaccaggtgcagagcctggaggccctgggccccatcaacgccagcctgatcgtgatggtgctggccagaaccgagctgcccgccctgagatacagattcaacgcccccatcgccagagacagcctgcccccctacagctggcactacgccccctggaccaagtgcagcgcccagtgcgccggcggcagccaggtgcaggccgtggagtgcagaaaccagctggacagcagcgccgtggccccccactactgcagcgcccacagcaagctgcccaagagacagagagcctgcaacaccgagccctgcccccccgactgggtggtgggcaactggagcctgtgcagcagaagctgcgacgccggcgtgagaagcagaagcgtggtgtgccagagaagagtgagcgccgccgaggagaaggccctggacgacagcgcctgcccccagcccagaccccccgtgctggaggcctgccacggccccacctgcccccccgagtgggccgccctggactggagcgagtgcacccccagctgcggccccggcctgagacacagagtggtgctgtgcaagagcgccgaccacagagccaccctgccccccgcccactgcagccccgccgccaagccccccgccaccatgagatgcaacctgagaagatgcccccccgccagatgggtggccggcgagtggggcgagtgcagcgcccagtgcggcgtgggccagagacagagaagcgtgagatgcaccagccacaccggccaggccagccacgagtgcaccgaggccctgagaccccccaccacccagcagtgcgaggccaagtgcgacagccccacccccggcgacggccccgaggagtgcaaggacgtgaacaaggtggcctactgccccctggtgctgaagttccagttctgcagcagagcctacttcagacagatgtgctgcaagacctgccacggccactag

SEQ ID NO: 17734 - DNA, 1998 bp, Artificial Sequence
  Description of Artificial Sequence: Synthetic coding sequence
atggccagcgccagccagggcgccgacgacgacggcagcagaagaaagcccagactggccgccagcctgcagatcagcccccagcccagaccctggagacccctgcccgcccaggcccagagcgcctggggccccgcccccgcccccgccacctacagagccgagggcggctggccccaggtgagcgtgctgagagacagcggccccggcgccggcgccggcgtgggcgagctgggcgccgccagagcctgggagaacctgggcgagcagatgggcaaggcccccagagtgcccgtgccccccgccggcctgagcctgcccctgaaggacccccccgccagccaggccgtgagcctgctgaccgagtacgccgccagcctgggcatcttcctgctgttcagagaggaccagccccccggcaaggtgttcaagtacagagcccccggcggcgaggagctgaaggccatgtgcctgtggcaggtggaggtgctgagagccttcctgctgagaaccggctggagaggcctgtggagaggcgacctggacctgggccccgacagcagctgggccaacagactgcccttcctgctgatctgcgagatggagagcagaatccccgccgtggaggagctgggcccctgcttccccttcagcgtgagcgccgagctggacggcgtggtgtgccccgccggcaccgccaacagcaagaccgaggccaagcagcaggccgccctgagcgccctgtgctacatcagaagccagctggagaaccccgagagcccccagaccagcagcagaccccccctggcccccctgagcgtggagaacatcctgacccacgagcagagatgcgccgccctggtgagcgccggcttcgacctgctgctggacgagagaagcccctactgggcctgcaagggcaccgtggccggcgtgatcctggagagaggctgggccgtgagcgcccccagctgcaccgagatccccagagccagaggccacgtgaaggagatctacaagctggtggccctgggcaccggcagcagctgctgcgccggctggctggagttcagcggccagcagctgcacgactgccacggcctggtgatcgccagaagagccctgctgagattcctgttcagacagctgctgctggccacccagggcggccccaagggcaaggagcagagcgtgctggccccccagcccggccccggcccccccttcaccctgaagcccagagtgttcctgcacctgtacatcagcaacacccccaagggcgccgccagagacatctacctgccccccaccagcgagggcggcctgccccacagcccccccatgagactgcaggcccacgtgctgggccagctgaagcccgtgtgctacgtggcccccagcctgtgcgacacccacgtgggctgcctgagcgccagcgacaagctggccagatgggccgtgctgggcctgggcggcgccctgctggcccacctggtgagccccctgtacagcaccagcctgatcctggccgacagctgccacgacccccccaccctgagcagagccatccacaccagaccctgcctggacagcgtgctgggcccctgcctgccccccccctacgtgagaaccgccctgcacctgttcgccggcccccccgtggcccccagcgagcccacccccgacacctgcagaggcctgagcctgaactggagcctgggcgaccccggcatcgaggtggtggacgtggccaccggcagagtgaaggccaacgccgccctgggcccccccagcagactgtgcaaggccagcttcctgagagccttccaccaggccgccagagccgtgggcaagccctacctgctggccctgaagacctacgaggccgccaaggccggcccctaccaggaggccagaagacagctgagcctgctgctggaccagcagggcctgggcgcctggcccagcaagcccctggtgggcaagttcagaaactag

SEQ ID NO: 17735 - DNA, 1752 bp, Artificial Sequence
  Description of Artificial Sequence: Synthetic coding sequence
atggccagcgccagccagggcgccgacgacgacggcagcagaagaaagcccagactggccgccagcctgcagatcagcccccagcccagaccctggagacccctgcccgcccaggcccagagcgcctggggccccgcccccgcccccgccacctacagagccgagggcggctggccccaggtgagcgtgctgagagacagcggccccggcgccggcgccggcgtgggcgagctgggcgccgccagagcctgggagaacctgggcgagcagatgggcaaggcccccagagtgcccgtgccccccgccggcctgagcctgcccctgaaggacccccccgccagccaggccgtgagcctgctgaccgagtacgccgccagcctgggcatcttcctgctgttcagagaggaccagccccccggcccctgcttccccttcagcgtgagcgccgagctggacggcgtggtgtgccccgccggcaccgccaacagcaagaccgaggccaagcagcaggccgccctgagcgccctgtgctacatcagaagccagctggagaaccccgagagcccccagaccagcagcagaccccccctggcccccctgagcgtggagaacatcctgacccacgagcagagatgcgccgccctggtgagcgccggcttcgacctgctgctggacgagagaagcccctactgggcctgcaagggcaccgtggccggcgtgatcctggagagagagatccccagagccagaggccacgtgaaggagatctacaagctggtggccctgggcaccggcagcagctgctgcgccggctggctggagttcagcggccagcagctgcacgactgccacggcctggtgatcgccagaagagccctgctgagattcctgttcagacagctgctgctggccacccagggcggccccaagggcaaggagcagagcgtgctggccccccagcccggccccggcccccccttcaccctgaagcccagagtgttcctgcacctgtacatcagcaacacccccaagggcgccgccagagacatctacctgccccccaccagcgagggcggcctgccccacagcccccccatgagactgcaggcccacgtgctgggccagctgaagcccgtgtgctacgtggcccccagcctgtgcgacacccacgtgggctgcctgagcgccagcgacaagctggccagatgggccgtgctgggcctgggcggcgccctgctggcccacctggtgagccccctgtacagcaccagcctgatcctggccgacagctgccacgacccccccaccctgagcagagccatccacaccagaccctgcctggacagcgtgctgggcccctgcctgccccccccctacgtgagaaccgccctgcacctgttcgccggcccccccgtggcccccagcgagcccacccccgacacctgcagaggcctgagcctgaactggagcctgggcgaccccggcatcgaggtggtggacgtggccaccggcagagtgaaggccaacgccgccctgggcccccccagcagactgtgcaaggccagcttcctgagagccttccaccaggccgccagagccgtgggcaagccctacctgctggccctgaagacctacgaggccgccaaggccggcccctaccaggaggccagaagacagctgagcctgctgctggaccagcagggcctgggcgcctggcccagcaagcccctggtgggcaagttcagaaactag

SEQ ID NO: 17736 - DNA, 576 bp, Artificial Sequence
  Description of Artificial Sequence: Synthetic coding sequence
atggaggccaaggccgcccccaagcccgccgccagcggcgcctgcagcgtgagcgccgaggagaccgagaagtggatggaggaggccatgcacatggccaaggaggccctggagaacaccgaggtgcccgtgggctgcctgatggtgtacaacaacgaggtggtgggcaagggcagaaacgaggtgaaccagaccaagaacgccaccagacacgccgagatggtggccatcgaccaggtgctggactggtgcagacagagcggcaagagccccagcgaggtgttcgagcacaccgtgctgtacgtgaccgtggagccctgcatcatgtgcgccgccgccctgagactgatgaagatccccctggtggtgtacggctgccagaacgagagattcggcggctgcggcagcgtgctgaacatcgccagcgccgacctgcccaacaccggcagacccttccagtgcatccccggctacagagccgaggaggccgtggagatgctgaagaccttctacaagcaggagaaccccaacgcccccaagagcaaggtgagaaagaaggagtgccagaagagctag

SEQ ID NO: 17737 - DNA, 111 bp, Artificial Sequence
  Description of Artificial Sequence: Synthetic coding sequence
atggaggccaaggccgcccccaagcccgccgccagcggcgcctgcagcgtgagcgccgaggagaccgagaagtggatggaggaggccatgcacatggagatcttcctgtag

SEQ ID NO: 17738 - DNA, 435 bp, Artificial Sequence
  Description of Artificial Sequence: Synthetic coding sequence
atggtgtacaacaacgaggtggtgggcaagggcagaaacgaggtgaaccagaccaagaacgccaccagacacgccgagatggtggccatcgaccaggtgctggactggtgcagacagagcggcaagagccccagcgaggtgttcgagcacaccgtgctgtacgtgaccgtggagccctgcatcatgtgcgccgccgccctgagactgatgaagatccccctggtggtgtacggctgccagaacgagagattcggcggctgcggcagcgtgctgaacatcgccagcgccgacctgcccaacaccggcagacccttccagtgcatccccggctacagagccgaggaggccgtggagatgctgaagaccttctacaagcaggagaaccccaacgcccccaagagcaaggtgagaaagaaggagtgccagaagagctag

SEQ ID NO: 17739 - DNA, 1056 bp, Artificial Sequence
  Description of Artificial Sequence: Synthetic coding sequence
atggagcccgcccccggcctggtggagcagcccaagtgcctggaggccggcagccccgagcccgagcccgccccctggcaggccctgcccgtgctgagcgagaagcagagcggcgacgtggagctggtgctggcctacgccgcccccgtgctggacaagagacagaccagcagactgctgaaggaggtgagcgccctgcaccccctgcccgcccagccccacctgaagagagtgagacccagcagagacgccggcagcccccacgccctggagatgctgctgtgcctggccggccccgccagcggccccagaagcctggccgagctgctgcccagacccgccgtggaccccagaggcctgggccagcccttcctggtgcccgtgcccgccagaccccccctgaccagaggccagttcgaggaggccagagcccactggcccaccagcttccacgaggacaagcaggtgaccagcgccctggccggcagactgttcagcacccaggagagagccgccatgcagagccacatggagagagccgtgtgggccgccagaagagccgccgccagaggcctgagagccgtgggcgccgtggtggtggaccccgccagcgacagagtgctggccaccggccacgactgcagctgcgccgacaaccccctgctgcacgccgtgatggtgtgcgtggacctggtggccagaggccagggcagaggcacctacgacttcagacccttccccgcctgcagcttcgcccccgccgccgccccccaggccgtgagagccggcgccgtgagaaagctggacgccgacgaggacggcctgccctacctgtgcaccggctacgacctgtacgtgaccagagagccctgcgccatgtgcgccatggccctggtgcacgccagaatcctgagagtgttctacggcgcccccagccccgacggcgccctgggcaccagattcagaatccacgccagacccgacctgaaccacagattccaggtgttcagaggcgtgctggaggagcagtgcagatggctggaccccgacacctag

SEQ ID NO: 17740 - DNA, 162 bp, Artificial Sequence
  Description of Artificial Sequence: Synthetic coding sequence
atggagcccgcccccggcctggtggagcagcccaagtgcctggaggccggcagccccgagcccgagcccgccccctggcaggccctgcccgtgctgagcgagaagcagagcggcgacgtggagctggtgctggcctacgccgcccccgtgctggacaagtag

SEQ ID NO: 17741 - DNA, 804 bp, Artificial Sequence
  Description of Artificial Sequence: Synthetic coding sequence
atgatcgaggccgaggagcagcagccctgcaagaccgacttctacagcgagctgcccaaggtggagctgcacgcccacctgaacggcagcatcagcagccacaccatgaagaagctgatcgcccagaagcccgacctgaagatccacgaccagatgaccgtgatcgacaagggcaagaagagaaccctggaggagtgcttccagatgttccagaccatccaccagctgaccagcagccccgaggacatcctgatggtgaccaaggacgtgatcaaggagttcgccgacgacggcgtgaagtacctggagctgagaagcacccccagaagagagaacgccaccggcatgaccaagaagacctacgtggagagcatcctggagggcatcaagcagagcaagcaggagaacctggacatcgacgtgagatacctgatcgccgtggacagaagaggcggccccctggtggccaaggagaccgtgaagctggccgaggagttcttcctgagcaccgagggcaccgtgctgggcctggacctgagcggcgaccccaccgtgggccaggccaaggacttcctggagcccctgctggaggccaagaaggccggcctgaagctggccctgcacctgagcgagatccccaaccagaagaaggagacccagatcctgctggacctgctgcccgacagaatcggccacggcaccttcctgaacagcggcgagggcggcagcctggacctggtggacttcgtgagacagcacagaatccccctgggcaaggcctggagcttcagaagcagcagatag

SEQ ID NO: 17742 - DNA, 1068 bp, Artificial Sequence
  Description of Artificial Sequence: Synthetic coding sequence
atgatcgaggccgaggagcagcagccctgcaagaccgacttctacagcgagctgcccaaggtggagctgcacgcccacctgaacggcagcatcagcagccacaccatgaagaagctgatcgcccagaagcccgacctgaagatccacgaccagatgaccgtgatcgacaagggcaagaagagaaccctggaggagtgcttccagatgttccagaccatccaccagctgaccagcagccccgaggacatcctgatggtgaccaaggacgtgatcaaggagttcgccgacgacggcgtgaagtacctggagctgagaagcacccccagaagagagaacgccaccggcatgaccaagaagacctacgtggagagcatcctggagggcatcaagcagagcaagcaggagaacctggacatcgacgtgagatacctgatcgccgtggacagaagaggcggccccctggtggccaaggagaccgtgaagctggccgaggagttcttcctgagcaccgagggcaccgtgctgggcctggacctgagcggcgaccccaccgtgggccaggccaaggacttcctggagcccctgctggaggccaagaaggccggcctgaagctggccctgcacctgagcgagatccccaaccagaagaaggagacccagatcctgctggacctgctgcccgacagaatcggccacggcaccttcctgaacagcggcgagggcggcagcctggacctggtggacttcgtgagacagcacagaatccccctggagctgtgcctgaccagcaacgtgaagagccagaccgtgcccagctacgaccagcaccacttcggcttctggtacagcatcgcccaccccagcgtgatctgcaccgacgacaagggcgtgttcgccacccacctgagccaggagtaccagctggccgccgagaccttcaacctgacccagagccaggtgtgggacctgagctacgagagcatcaactacatcttcgccagcgacagcaccagaagcgagctgagaaagaagtggaaccacctgaagcccagagtgctgcacatctag

SEQ ID NO: 17743 - DNA, 987 bp, Artificial Sequence
  Description of Artificial Sequence: Synthetic coding sequence
atgatcgaggccgaggagcagcagccctgcaagaccgacttctacagcgagctgcccaaggtggagctgcacgcccacctgaacggcagcatcagcagccacaccatgaagaagctgatcgcccagaagcccgacctgaagatccacgaccagatgaccgtgatcgacaagggcaagaagagaaccctggaggagtgcttccagatgttccagaccatccaccagctgaccagcagccccgaggacatcctgatggtgaccaaggacgtgatcaaggagttcgccgacgacggcgtgaagtacctggagctgagaagcacccccagaagagagaacgccaccggcatgaccaagaagacctacgtggagagcatcctggagggcatcaagcagagcaagcaggagaacctggacatcgacgtgagatacctgatcgccgtggacagaagaggcggccccctggtggccaaggagaccgtgaagctggccgaggagttcttcctgagcaccgagggcaccgtgctgggcctggacctgagcggcgaccccaccatccccaaccagaagaaggagacccagatcctgctggacctgctgcccgacagaatcggccacggcaccttcctgaacagcggcgagggcggcagcctggacctggtggacttcgtgagacagcacagaatccccctggagctgtgcctgaccagcaacgtgaagagccagaccgtgcccagctacgaccagcaccacttcggcttctggtacagcatcgcccaccccagcgtgatctgcaccgacgacaagggcgtgttcgccacccacctgagccaggagtaccagctggccgccgagaccttcaacctgacccagagccaggtgtgggacctgagctacgagagcatcaactacatcttcgccagcgacagcaccagaagcgagctgagaaagaagtggaaccacctgaagcccagagtgctgcacatctag

SEQ ID NO: 17744 - DNA, 1836 bp, Artificial Sequence
  Description of Artificial Sequence: Synthetic coding sequence
atgagcgtgcaggtggtgagcgccgccgccgccgccaaggtgcccgaggtggagctgaaggacctgagccccagcgaggccgagagccagctgggcctgagcaccgccgccgtgggcgccatggccccccccgccggcggcggcgaccccgaggcccccgcccccgccgccgagagaccccccgtgcccggccccggcagcggccccgccgccgccctgagccccgccgccggcaaggtgccccaggccagcgccatgaagagaagcgacccccaccaccagcaccagagacacagagacggcggcgaggccctggtgagccccgacggcaccgtgaccgaggcccccagaaccgtgaagaagcagatccagttcgccgaccagaagcaggagttcaacaagagacccaccaagatcggcagaagaagcctgagcagaagcatcagccagagcagcaccgacagctacagcagcgccgccagctacaccgacagcagcgacgacgagaccagccccagagacaagcagcagaagaacagcaagggcagcagcgacttctgcgtgaagaacatcaagcaggccgagttcggcagaagagagatcgagatcgccgagcaggagatgcccgccctgatggccctgagaaagagagcccagggcgagaagcccctggccggcgccaagatcgtgggctgcacccacatcaccgcccagaccgccgtgctgatggagaccctgggcgccctgggcgcccagtgcagatgggccgcctgcaacatctacagcaccctgaacgaggtggccgccgccctggccgagagcggcttccccgtgttcgcctggaagggcgagagcgaggacgacttctggtggtgcatcgacagatgcgtgaacgtggagggctggcagcccaacatgatcctggacgacggcggcgacctgacccactggatctacaagaagtaccccaacatgttcaagaagatcaagggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacatgatgttcggcggcaagcaggtggtggtgtgcggctacggcgaggtgggcaagggctgctgcgccgccctgaaggccatgggcagcatcgtgtacgtgaccgagatcgaccccatctgcgccctgcaggcctgcatggacggcttcagactggtgaagctgaacgaggtgatcagacaggtggacatcgtgatcacctgcaccggcaacaagaacgtggtgaccagagagcacctggacagaatgaagaacagctgcatcgtgtgcaacatgggccacagcaacaccgagatcgacgtggccagcctgagaacccccgagctgacctgggagagagtgagaagccaggtggaccacgtgatctggcccgacggcaagagaatcgtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccaccttcgacgcccacctgaccgagctgaccgacgagcaggccaagtacctgggcctgaacaagaacggccccttcaagcccaactactacagatactag

SEQ ID NO: 17745 - DNA, 1530 bp, Artificial Sequence
  Description of Artificial Sequence: Synthetic coding sequence
atggagaagtgggacggcaacgagggcaccagcgccttccacatgcccgagtggatgcagatccagttcgccgaccagaagcaggagttcaacaagagacccaccaagatcggcagaagaagcctgagcagaagcatcagccagagcagcaccgacagctacagcagcgccgccagctacaccgacagcagcgacgacgagaccagccccagagacaagcagcagaagaacagcaagggcagcagcgacttctgcgtgaagaacatcaagcaggccgagttcggcagaagagagatcgagatcgccgagcaggagatgcccgccctgatggccctgagaaagagagcccagggcgagaagcccctggccggcgccaagatcgtgggctgcacccacatcaccgcccagaccgccgtgctgatggagaccctgggcgccctgggcgcccagtgcagatgggccgcctgcaacatctacagcaccctgaacgaggtggccgccgccctggccgagagcggcttccccgtgttcgcctggaagggcgagagcgaggacgacttctggtggtgcatcgacagatgcgtgaacgtggagggctggcagcccaacatgatcctggacgacggcggcgacctgacccactggatctacaagaagtaccccaacatgttcaagaagatcaagggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacatgatgttcggcggcaagcaggtggtggtgtgcggctacggcgaggtgggcaagggctgctgcgccgccctgaaggccatgggcagcatcgtgtacgtgaccgagatcgaccccatctgcgccctgcaggcctgcatggacggcttcagactggtgaagctgaacgaggtgatcagacaggtggacatcgtgatcacctgcaccggcaacaagaacgtggtgaccagagagcacctggacagaatgaagaacagctgcatcgtgtgcaacatgggccacagcaacaccgagatcgacgtggccagcctgagaacccccgagctgacctgggagagagtgagaagccaggtggaccacgtgatctggcccgacggcaagagaatcgtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccaccttcgacgcccacctgaccgagctgaccgacgagcaggccaagtacctgggcctgaacaagaacggccccttcaagcccaactactacagatactag

SEQ ID NO: 17746 - DNA, 1833 bp, Artificial Sequence
  Description of Artificial Sequence: Synthetic coding sequence
atgagcgtgcaggtggtgagcgccgccgccgccgccaaggtgcccgaggtggagctgaaggacctgagccccagcgaggccgagagccagctgggcctgagcaccgccgccgtgggcgccatggccccccccgccggcggcggcgaccccgaggcccccgcccccgccgccgagagaccccccgtgcccggccccggcagcggccccgccgccgccctgagccccgccgccggcaaggtgccccaggccagcgccatgaagagaagcgacccccaccaccagcaccagagacacagagacggcggcgaggccctggtgagccccgacggcaccgtgaccgaggcccccagaaccgtgaagaagatccagttcgccgaccagaagcaggagttcaacaagagacccaccaagatcggcagaagaagcctgagcagaagcatcagccagagcagcaccgacagctacagcagcgccgccagctacaccgacagcagcgacgacgagaccagccccagagacaagcagcagaagaacagcaagggcagcagcgacttctgcgtgaagaacatcaagcaggccgagttcggcagaagagagatcgagatcgccgagcaggagatgcccgccctgatggccctgagaaagagagcccagggcgagaagcccctggccggcgccaagatcgtgggctgcacccacatcaccgcccagaccgccgtgctgatggagaccctgggcgccctgggcgcccagtgcagatgggccgcctgcaacatctacagcaccctgaacgaggtggccgccgccctggccgagagcggcttccccgtgttcgcctggaagggcgagagcgaggacgacttctggtggtgcatcgacagatgcgtgaacgtggagggctggcagcccaacatgatcctggacgacggcggcgacctgacccactggatctacaagaagtaccccaacatgttcaagaagatcaagggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacatgatgttcggcggcaagcaggtggtggtgtgcggctacggcgaggtgggcaagggctgctgcgccgccctgaaggccatgggcagcatcgtgtacgtgaccgagatcgaccccatctgcgccctgcaggcctgcatggacggcttcagactggtgaagctgaacgaggtgatcagacaggtggacatcgtgatcacctgcaccggcaacaagaacgtggtgaccagagagcacctggacagaatgaagaacagctgcatcgtgtgcaacatgggccacagcaacaccgagatcgacgtggccagcctgagaacccccgagctgacctgggagagagtgagaagccaggtggaccacgtgatctggcccgacggcaagagaatcgtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccaccttcgacgcccacctgaccgagctgaccgacgagcaggccaagtacctgggcctgaacaagaacggccccttcaagcccaactactacagatactag

SEQ ID NO: 17747 - DNA, 228 bp, Artificial Sequence
  Description of Artificial Sequence: Synthetic coding sequence
atggagaagtgggacggcaacgagggcaccagcgccttccacatgcccgagtggatgcagatccagttcgccgaccagaagcaggagttcaacaagagacccaccaagatcggcagaagaagcctgagcagaagcatcagccagagcagcaccgacagctacagcagcgccgccagctacaccgacagcagcgacgacgagaccagccccagagacaagcagcagtag

SEQ ID NO: 17748 - DNA, 1527 bp, Artificial Sequence
  Description of Artificial Sequence: Synthetic coding sequence
atggagaagtgggacggcaacgagggcaccagcgccttccacatgcccgagtggatgatccagttcgccgaccagaagcaggagttcaacaagagacccaccaagatcggcagaagaagcctgagcagaagcatcagccagagcagcaccgacagctacagcagcgccgccagctacaccgacagcagcgacgacgagaccagccccagagacaagcagcagaagaacagcaagggcagcagcgacttctgcgtgaagaacatcaagcaggccgagttcggcagaagagagatcgagatcgccgagcaggagatgcccgccctgatggccctgagaaagagagcccagggcgagaagcccctggccggcgccaagatcgtgggctgcacccacatcaccgcccagaccgccgtgctgatggagaccctgggcgccctgggcgcccagtgcagatgggccgcctgcaacatctacagcaccctgaacgaggtggccgccgccctggccgagagcggcttccccgtgttcgcctggaagggcgagagcgaggacgacttctggtggtgcatcgacagatgcgtgaacgtggagggctggcagcccaacatgatcctggacgacggcggcgacctgacccactggatctacaagaagtaccccaacatgttcaagaagatcaagggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacatgatgttcggcggcaagcaggtggtggtgtgcggctacggcgaggtgggcaagggctgctgcgccgccctgaaggccatgggcagcatcgtgtacgtgaccgagatcgaccccatctgcgccctgcaggcctgcatggacggcttcagactggtgaagctgaacgaggtgatcagacaggtggacatcgtgatcacctgcaccggcaacaagaacgtggtgaccagagagcacctggacagaatgaagaacagctgcatcgtgtgcaacatgggccacagcaacaccgagatcgacgtggccagcctgagaacccccgagctgacctgggagagagtgagaagccaggtggaccacgtgatctggcccgacggcaagagaatcgtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccaccttcgacgcccacctgaccgagctgaccgacgagcaggccaagtacctgggcctgaacaagaacggccccttcaagcccaactactacagatactag

SEQ ID NO: 17749 - DNA, 1593 bp, Artificial Sequence
  Description of Artificial Sequence: Synthetic coding sequence
atgtacttcctgtgcttcttctgcctgttcgtgagcggcagaaagtggagcagacagttcctgctgagcttctggtgcaccgtgtgcagcgcccaccagggcaccatcttcctgagcctgaagatccagttcgccgaccagaagcaggagttcaacaagagacccaccaagatcggcagaagaagcctgagcagaagcatcagccagagcagcaccgacagctacagcagcgccgccagctacaccgacagcagcgacgacgagaccagccccagagacaagcagcagaagaacagcaagggcagcagcgacttctgcgtgaagaacatcaagcaggccgagttcggcagaagagagatcgagatcgccgagcaggagatgcccgccctgatggccctgagaaagagagcccagggcgagaagcccctggccggcgccaagatcgtgggctgcacccacatcaccgcccagaccgccgtgctgatggagaccctgggcgccctgggcgcccagtgcagatgggccgcctgcaacatctacagcaccctgaacgaggtggccgccgccctggccgagagcggcttccccgtgttcgcctggaagggcgagagcgaggacgacttctggtggtgcatcgacagatgcgtgaacgtggagggctggcagcccaacatgatcctggacgacggcggcgacctgacccactggatctacaagaagtaccccaacatgttcaagaagatcaagggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacatgatgttcggcggcaagcaggtggtggtgtgcggctacggcgaggtgggcaagggctgctgcgccgccctgaaggccatgggcagcatcgtgtacgtgaccgagatcgaccccatctgcgccctgcaggcctgcatggacggcttcagactggtgaagctgaacgaggtgatcagacaggtggacatcgtgatcacctgcaccggcaacaagaacgtggtgaccagagagcacctggacagaatgaagaacagctgcatcgtgtgcaacatgggccacagcaacaccgagatcgacgtggccagcctgagaacccccgagctgacctgggagagagtgagaagccaggtggaccacgtgatctggcccgacggcaagagaatcgtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccaccttcgacgcccacctgaccgagctgaccgacgagcaggccaagtacctgggcctgaacaagaacggccccttcaagcccaactactacagatactag

SEQ ID NO: 17750 - DNA, 1527 bp, Artificial Sequence
  Description of Artificial Sequence: Synthetic coding sequence
atgctgggcagcaagaagaagtacatcgtgaacggcaacagcggcatcaaggcccagatccagttcgccgaccagaagcaggagttcaacaagagacccaccaagatcggcagaagaagcctgagcagaagcatcagccagagcagcaccgacagctacagcagcgccgccagctacaccgacagcagcgacgacgagaccagccccagagacaagcagcagaagaacagcaagggcagcagcgacttctgcgtgaagaacatcaagcaggccgagttcggcagaagagagatcgagatcgccgagcaggagatgcccgccctgatggccctgagaaagagagcccagggcgagaagcccctggccggcgccaagatcgtgggctgcacccacatcaccgcccagaccgccgtgctgatggagaccctgggcgccctgggcgcccagtgcagatgggccgcctgcaacatctacagcaccctgaacgaggtggccgccgccctggccgagagcggcttccccgtgttcgcctggaagggcgagagcgaggacgacttctggtggtgcatcgacagatgcgtgaacgtggagggctggcagcccaacatgatcctggacgacggcggcgacctgacccactggatctacaagaagtaccccaacatgttcaagaagatcaagggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacatgatgttcggcggcaagcaggtggtggtgtgcggctacggcgaggtgggcaagggctgctgcgccgccctgaaggccatgggcagcatcgtgtacgtgaccgagatcgaccccatctgcgccctgcaggcctgcatggacggcttcagactggtgaagctgaacgaggtgatcagacaggtggacatcgtgatcacctgcaccggcaacaagaacgtggtgaccagagagcacctggacagaatgaagaacagctgcatcgtgtgcaacatgggccacagcaacaccgagatcgacgtggccagcctgagaacccccgagctgacctgggagagagtgagaagccaggtggaccacgtgatctggcccgacggcaagagaatcgtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccaccttcgacgcccacctgaccgagctgaccgacgagcaggccaagtacctgggcctgaacaagaacggccccttcaagcccaactactacagatactag

SEQ ID NO: 17751 - DNA, 1266 bp, Artificial Sequence
  Description of Artificial Sequence: Synthetic coding sequence
atgaccagccaggagaagaccgaggagtaccccttcgccgacatcttcgacgaggacgagaccgagagaaacttcctgctgagcaagcccgtgtgcttcgtggtgttcggcaagcccggcgtgggcaagaccaccctggccagatacatcacccaggcctggaagtgcatcagagtggaggccctgcccatcctggaggagcagatcgccgccgagaccgagagcggcgtgatgctgcagagcatgctgatcagcggccagagcatccccgacgagctggtgatcaagctgatgctggagaagctgaacagccccgaggtgtgccacttcggctacatcatcaccgagatccccagcctgagccaggacgccatgaccaccctgcagcagatcgagctgatcaagaacctgaacctgaagcccgacgtgatcatcaacatcaagtgccccgactacgacctgtgccagagaatcagcggccagagacagcacaacaacaccggctacatctacagcagagaccagtgggaccccgaggtgatcgagaaccacagaaagaagaagaaggaggcccagaaggacggcaagggcgaggaggaggaggaggaggaggagcaggaggaggaggaggccttcatcgccgagatgcagatggtggccgagatcctgcaccacctggtgcagagacccgaggactacctggagaacgtggagaacatcgtgaagctgtacaaggagaccatcctgcagaccctggaggaggtgatggccgagcacaacccccagtacctgatcgagctgaacggcaacaagcccgccgaggagctgttcatgatcgtgatggacagactgaagtacctgaacctgaagagagccgccatcctgaccaagctgcagggcgccgaggaggagatcaacgacaccatggagaacgacgagctgttcagaaccctggccagctacaagctgatcgcccccagatacagatggcagagaagcaagtggggcagaacctgccccgtgaacctgaaggacggcaacatctacagcggcctgcccgactacagcgtgagcttcctgggcaagatctactgcctgagcagcgaggaggccctgaagcccttcctgctgaaccccagaccctacctgctgccccccatgcccggccccccctgcaaggtgttcatcctgggcccccagtacagcggcaagaccaccctgtgcaacatgctggccgagaactacaagggcaaggtgaccaactag

SEQ ID NO: 17752 - DNA, 1089 bp, Artificial Sequence
  Description of Artificial Sequence: Synthetic coding sequence
atgaaggagagaaagagacacctgggcgacaccaagcacttctgccccgtggtgctgaaggagaacttcatcctgcagcccggcaacaccgaggaggccgccaagtacagagagaagatctactacttcagcagcgccgaggccaaggagaagttcctggagcaccccgaggactacgtggcccacgaggagcccctgaaggccccccccctgagaatctgcctggtgggcccccagggcagcggcaagaccatgtgcggcagacagctggccgagaagctgaacatcttccacatccagttcgaggaggtgctgcaggagaagctgctgctgaagaccgagaagaaggtgggccccgagttcgaggaggacagcgagaacgagcaggccgccaagcaggagctggaggagctggccatccaggccaacgtgaaggtggaggaggagaacaccaagaagcagctgcccgaggtgcagctgaccgaggaggaggaggtgatcaagagcagcctgatggagaacgagcccctgccccccgagatcctggaggtgatcctgagcgagtggtggctgaaggagcccatcagaagcaccggcttcatcctggacggcttccccagataccccgaggaggcccagttcctgggcgacagaggcttcttccccgacgccgccgtgttcatccaggtggacgaccaggacatcttcgacagactgctgcccgcccagatcgagaagtggaagctgaagcagaagaagaagctggagagaaagaagctgatcaaggacatgaaggccaagatcagagtggacaccatcgccaagagaagagccgagctgatcctggagagagacaagaagagaagagagcccaacaaggagaagagaaagagaggcatcagcgagaacaccacctgctacaagtgcaaccacatgagcccctggtgcgagtacgccggcctgccctacagaggcctgctgatcctgtacagcgccaccgccaccgccaccgccggcaccaagcactgcagaagcggcgccaaggtgatcgtggccctgagcaagcagaacatccacaaccagaagtag

SEQ ID NO: 17753 - DNA, 2211 bp, Artificial Sequence
  Description of Artificial Sequence: Synthetic coding sequence
atgaccagccaggagaagaccgaggagtaccccttcgccgacatcttcgacgaggacgagaccgagagaaacttcctgctgagcaagcccgtgtgcttcgtggtgttcggcaagcccggcgtgggcaagaccaccctggccagatacatcacccaggcctggaagtgcatcagagtggaggccctgcccatcctggaggagcagatcgccgccgagaccgagagcggcgtgatgctgcagagcatgctgatcagcggccagagcatccccgacgagctggtgatcaagctgatgctggagaagctgaacagccccgaggtgtgccacttcggctacatcatcaccgagatccccagcctgagccaggacgccatgaccaccctgcagcagatcgagctgatcaagaacctgaacctgaagcccgacgtgatcatcaacatcaagtgccccgactacgacctgtgccagagaatcagcggccagagacagcacaacaacaccggctacatctacagcagagaccagtgggaccccgaggtgatcgagaaccacagaaagaagaagaaggaggcccagaaggacggcaagggcgaggaggaggaggaggaggaggagcaggaggaggaggaggccttcatcgccgagatgcagatggtggccgagatcctgcaccacctggtgcagagacccgaggactacctggagaacgtggagaacatcgtgaagctgtacaaggagaccatcctgcagaccctggaggaggtgatggccgagcacaacccccagtacctgatcgagctgaacggcaacaagcccgccgaggagctgttcatgatcgtgatggacagactgaagtacctgaacctgaagagagccgccatcctgaccaagctgcagggcgccgaggaggagatcaacgacaccatggagaacgacgagctgttcagaaccctggccagctacaagctgatcgcccccagatacagatggcagagaagcaagtggggcagaacctgccccgtgaacctgaaggacggcaacatctacagcggcctgcccgactacagcgtgagcttcctgggcaagatctactgcctgagcagcgaggaggccctgaagcccttcctgctgaaccccagaccctacctgctgccccccatgcccggccccccctgcaaggtgttcatcctgggcccccagtacagcggcaagaccaccctgtgcaacatgctggccgagaactacaagggcaaggtggtggactacgcccagctggtgcagcccagattcgacaaggccagagagaccctggtggagaacaccatcgccgaggccaccgccgccgccatcaaggtggtgaaggagaagctgctgagagagctgcaggccagaaagcaggccgagaccgccctgagagagttccagagacagtacgagaagatggagttcggcgtgttccccatggaggccacccacagcagcatcgacgaggagggctacatccagggcagccagagagacagaggcagcagcctggtggacaccgaggaggccaagaccaagagcgagaacgtgctgcacgaccaggccgccaaggtggacaaggacgacggcaaggagaccggcgagaccttcaccttcaagagacacagccaggacgccagccaggacgtgaagctgtacagcgacaccgcccccaccgaggacctgatcgaggaggtgaccgccgaccaccccgaggtggtgaccatgatcgaggagaccatcaagatgagccaggacatcaacttcgagcagccctacgagaagcacgccgagatcctgcaggaggtgctgggcgaggtgatggaggagaacaaggacagattccccggcgcccccaagtacggcggctggatcgtggacaactgccccatcgtgaaggagctgtggatggccctgatcaagaagggcatcatccccgacctggtgatctacctgagcgacaccgagaacaacggcaagtgcctgttcaacagaatctacctgcagaagaagagcgagatcgacagcaagatcctggagagactgctggaggagctgcagaagaagaagaaggaggaggaggaggccagaaaggccaccgaggaggagctgagactggaggaggagaacagaagactgctggagctgatgaaggtgaaggccaagggcaagcacagactgctgtag

SEQ ID NO: 17754 - DNA, 5736 bp, Artificial Sequence
  Description of Artificial Sequence: Synthetic coding sequence
atgaccagccaggagaagaccgaggagtaccccttcgccgacatcttcgacgaggacgagaccgagagaaacttcctgctgagcaagcccgtgtgcttcgtggtgttcggcaagcccggcgtgggcaagaccaccctggccagatacatcacccaggcctggaagtgcatcagagtggaggccctgcccatcctggaggagcagatcgccgccgagaccgagagcggcgtgatgctgcagagcatgctgatcagcggccagagcatccccgacgagctggtgatcaagctgatgctggagaagctgaacagccccgaggtgtgccacttcggctacatcatcaccgagatccccagcctgagccaggacgccatgaccaccctgcagcagatcgagctgatcaagaacctgaacctgaagcccgacgtgatcatcaacatcaagtgccccgactacgacctgtgccagagaatcagcggccagagacagcacaacaacaccggctacatctacagcagagaccagtgggaccccgaggtgatcgagaaccacagaaagaagaagaaggaggcccagaaggacggcaagggcgaggaggaggaggaggaggaggagcaggaggaggaggaggccttcatcgccgagatgcagatggtggccgagatcctgcaccacctggtgcagagacccgaggactacctggagaacgtggagaacatcgtgaagctgtacaaggagaccatcctgcagaccctggaggaggtgatggccgagcacaacccccagtacctgatcgagctgaacggcaacaagcccgccgaggagctgttcatgatcgtgatggacagactgaagtacctgaacctgaagagagccgccatcctgaccaagctgcagggcgccgaggaggagatcaacgacaccatggagaacgacgagctgttcagaaccctggccagctacaagctgatcgcccccagatacagatggcagagaagcaagtggggcagaacctgccccgtgaacctgaaggacggcaacatctacagcggcctgcccgactacagcgtgagcttcctgggcaagatctactgcctgagcagcgaggaggccctgaagcccttcctgctgaaccccagaccctacctgctgccccccatgcccggccccccctgcaaggtgttcatcctgggcccccagtacagcggcaagaccaccctgtgcaacatgctggccgagaactacaagggcaaggtggtggactacgcccagctggtgcagcccagattcgacaaggccagagagaccctggtggagaacaccatcgccgaggccaccgccgccgccatcaaggtggtgaaggagaagctgctgagagagctgcaggccagaaagcaggccgagaccgccctgagagagttccagagacagtacgagaagatggagttcggcgtgttccccatggaggccacccacagcagcatcgacgaggagggctacatccagggcagccagagagacagaggcagcagcctggtggacaccgaggaggccaagaccaagagcgagaacgtgctgcacgaccaggccgccaaggtggacaaggacgacggcaaggagaccggcgagaccttcaccttcaagagacacagccaggacgccagccaggacgtgaagctgtacagcgacaccgcccccaccgaggacctgatcgaggaggtgaccgccgaccaccccgaggtggtgaccatgatcgaggagaccatcaagatgagccaggacatcaacttcgagcagccctacgagaagcacgccgagatcctgcaggaggtgctgggcgaggtgatggaggagaacaaggacagattccccggcgcccccaagtacggcggctggatcgtggacaactgccccatcgtgaaggagctgtggatggccctgatcaagaagggcatcatccccgacctggtgatctacctgagcgacaccgagaacaacggcaagtgcctgttcaacagaatctacctgcagaagaagagcgagatcgacagcaagatcctggagagactgctggaggagctgcagaagaagaagaaggaggaggaggaggccagaaaggccaccgaggaggagctgagactggaggaggagaacagaagactgctggagctgatgaaggtgaaggccaaggaggccgaggagaccgacaacgaggacgaggaggagatcgagggcgacgagctggaggtgcacgaggagcccgaggccagccacgacaccagaggcagctggctgcccgaggagttcgaggccagcgaggtgcccgagaccgagcccgaggccgtgagcgagcccatcgaggagaccaccgtggagaccgagatccccaagggcagcaaggagggcctggagatcgagaagctgagcgagaccgtggtgctgcccgagttccccgaggacagctaccccgacgtgcccgagatggagcccttcaaggagaagatcggcagcttcatcatcctgtggaagcagctggaggccaccatcagcgaggcctacatcaagatcctgaacctggagatcgccgacagaaccccccaggagctgctgcagaaggtggtggagaccatggagaagcccttccagtacaccgcctgggagctgaccggcgaggactacgaggaggagaccgaggactaccagaccgaggccgaggtggacgaggagctggaggaggaggaggaggaggagggcgaggacaagatgaaggagagaaagagacacctgggcgacaccaagcacttctgccccgtggtgctgaaggagaacttcatcctgcagcccggcaacaccgaggaggccgccaagtacagagagaagatctactacttcagcagcgccgaggccaaggagaagttcctggagcaccccgaggactacgtggcccacgaggagcccctgaaggccccccccctgagaatctgcctggtgggcccccagggcagcggcaagaccatgtgcggcagacagctggccgagaagctgaacatcttccacatccagttcgaggaggtgctgcaggagaagctgctgctgaagaccgagaagaaggtgggccccgagttcgaggaggacagcgagaacgagcaggccgccaagcaggagctggaggagctggccatccaggccaacgtgaaggtggaggaggagaacaccaagaagcagctgcccgaggtgcagctgaccgaggaggaggaggtgatcaagagcagcctgatggagaacgagcccctgccccccgagatcctggaggtgatcctgagcgagtggtggctgaaggagcccatcagaagcaccggcttcatcctggacggcttccccagataccccgaggaggcccagttcctgggcgacagaggcttcttccccgacgccgccgtgttcatccaggtggacgaccaggacatcttcgacagactgctgcccgcccagatcgagaagtggaagctgaagcagaagaagaagctggagagaaagaagctgatcaaggacatgaaggccaagatcagagtggacaccatcgccaagagaagagccgagctgatcctggagagagacaagaagagaagagagaacgtggtgagagacgacgaggagatcagcgaggaggagctggaggaggacaacgacgacatcgagaacatcctggaggacgagttccccaaggacgaggaggagatgagcggcgaggaggacgaggagcaggagaccgacgccatcgagagactgagaggcgagctgggcgagaagttcgaggccgacacccacaacctgcagatcatccaggacgagctggagagatacctgatccccatcatcagcatcaacggcgccagaagaaaccacatcgtgcagtacaccctgaacatgaagctgaagcccctggtggagaacagagccagcatcttcgagaagtgccaccccatccccgcccccctggcccagaagatgctgaccttcacctacaagtacatcagcagcttcggctactgggaccccgtgaagctgagcgagggcgagaccatcaagcccgtggagaacgccgagaaccccatctaccccgtgatccacagacagtacatctacttcctgagcagcaaggagaccaaggagaagttcatgaagaaccccatcaagtacatcagacagcccaagcccaagcccaccgtgcccatcagaatcatcatcgtgggcccccccaagagcggcaagaccaccgtggccaagaagatcaccagcgagtacggcctgaagcacctgagcatcggcggcgccctgagatacgtgctgaacaaccaccccgagaccgagctggccctgatgctgaactggcacctgcacaagggcatgaccgcccccgacgagctggccatccaggccctggagctgagcctgatggagagcgtgtgcaacaccgccggcgtggtgatcgacggctaccccgtgaccaagcaccagatgaacctgctggaggccagaagcatcatccccatggtgatcttcgagctgagcgtgcccagcaaggagatcttcaagagactgctgctggagaaggagaacgagcagagactgccctaccccctgcacaacagcgcccagatcgtggccgtgaacaacgtgaagtacagaaagaacatcggcgagatcagacagtactaccaggagcagcaccagaactggtacgtgatcgacggcttccacagcaagtggtgggtgtggaacgaggtgatcaagaacgtgcagatggtgaacaagtacatgcagacctacctggagagaatcaaggccggcaaggccgcctgcatcgacaagctgtgcatcaccccccaggagctgctgagcagactgggcgagttcgagcagttctgccccgtgagcctggccgagagccaggagctgttcgactgcagcgccaccgacagcctggagttcgccgccgagttcagaggccactactacaagatgagcagccaggagaagctgaacaagttcctggagaaccccgagctgtacgtgccccccctggccccccaccccctgcccagcgccgacatgatccccaagagactgaccctgagcgagctgaagagcagattccccaagtgcgccgagctgcagggctactgccccgtgacctacaaggacggcaaccagagatacgaggccctggtgcccggcagcatcaactacgccctggagtaccacaacagaatctacatctgcgagaacaaggagaagctgcagaagttcctgagaagccccctgaagtactgggagcagaagctgccccacaagctgccccccctgagagagcccatcctgctgaccagcctgcccctgcccggctacctggagcagggcatcgccaccagcctgatcaaggccatgaacgccgccggctgcctgaagcccaagttccccttcctgagcatcagaagaagcgccctgctgtacatcgccctgcacctgaaggccttcaaccccaagggcagcgagtacaccagaaagaagtacaagaagaagatggagcagttcatggagagctgcgagctgatcacctacctgggcgccaagatgaccagaaagtacaaggagccccagttcagagccatcgacttcgaccacaagctgaagaccttcctgagcctgagaaacatcgaccccatcaacggctag

SEQ ID NO: 17755 - DNA, 684 bp, Artificial Sequence
  Description of Artificial Sequence: Synthetic coding sequence
atgctgcagagcatgctgatcagcggccagagcatccccgacgagctggtgatcaagctgatgctggagaagctgaacagccccgaggtgtgccacttcggctacatcatcaccgagatccccagcctgagccaggacgccatgaccaccctgcagcagatcgagctgatcaagaacctgaacctgaagcccgacgtgatcatcaacatcaagtgccccgactacgacctgtgccagagaatcagcggccagagacagcacaacaacaccggctacatctacagcagagaccagtgggaccccgaggtgatcgagaaccacagaaagaagaagaaggaggcccagaaggacggcaagggcgaggaggaggaggaggaggaggagcaggaggaggaggaggccttcatcgccgagatgcagatggtggccgagatcctgcaccacctggtgcagagacccgaggactacctggagaacgtggagaacatcgtgaagctgtacaaggagaccatcctgcagaccctggaggaggtgatggccgagcacaacccccagtacctgatcgagctgaacggcaacaagcccgccgaggagctgttcatgatcgtgatggacagactgaagtacctgaacctgaagagagccgccatcctgaccaagctgcagggcgccgaggaggagtag

SEQ ID NO: 17756 - DNA, 1074 bp, Artificial Sequence
  Description of Artificial Sequence: Synthetic coding sequence
atggagaagtacgtggccgccatggtgctgagcgccgccggcgacgccctgggctactacaacggcaagtgggagttcctgcaggacggcgagaagatccacagacagctggcccagctgggcggcctggacgccctggacgtgggcagatggagagtgagcgacgacaccgtgatgcacctggccaccgccgaggccctggtggaggccggcaaggcccccaagctgacccagctgtactacctgctggccaagcactaccaggactgcatggaggacatggacggcagagcccccggcggcgccagcgtgcacaacgccatgcagctgaagcccggcaagcccaacggctggagaatccccttcaacagccacgagggcggctgcggcgccgccatgagagccatgtgcatcggcctgagattcccccaccacagccagctggacaccctgatccaggtgagcatcgagagcggcagaatgacccaccaccaccccaccggctacctgggcgccctggccagcgccctgttcaccgcctacgccgtgaacagcagaccccccctgcagtggggcaagggcctgatggagctgctgcccgaggccaagaagtacatcgtgcagagcggctacttcgtggaggagaacctgcagcactggagctacttccagaccaagtgggagaactacctgaagctgagaggcatcctggacggcgagagcgcccccaccttccccgagagcttcggcgtgaaggagagagaccagttctacaccagcctgagctacagcggctggggcggcagcagcggccacgacgcccccatgatcgcctacgacgccgtgctggccgccggcgacagctggaaggagctggcccacagagccttcttccacggcggcgacagcgacagcaccgccgccatcgccggctgctggtggggcgtgatgtacggcttcaagggcgtgagccccagcaactacgagaagctggagtacagaaacagactggaggagaccgccagagccctgtacagcctgggcagcaaggaggacaccgtgatcagcctgtag

SEQ ID NO: 17757 - DNA, 1074 bp, Artificial Sequence; identical to SEQ ID NO: 17756
  Description of Artificial Sequence: Synthetic coding sequence

SEQ ID NO: 17758 - DNA, 1074 bp, Artificial Sequence; identical to SEQ ID NO: 17756
  Description of Artificial Sequence: Synthetic coding sequence

SEQ ID NO: 17759 - DNA, 1074 bp, Artificial Sequence; identical to SEQ ID NO: 17756
  Description of Artificial Sequence: Synthetic coding sequence

SEQ ID NO: 17760 - DNA, 378 bp, Artificial Sequence
  Description of Artificial Sequence: Synthetic coding sequence
atggagaagtacgtggccgccatggtgctgagcgccgccggcgacgccctgggctactacaacggcaagtgggagttcctgcaggacggcgagaagatccacagacagctggcccagctgggcggcctggacgccctggacgtgggcagatggagagtgagcgacgacaccgtgatgcacctggccaccgccgaggccctggtggaggccggcaaggcccccaagctgacccagctgtactacctgctggccaagcactaccaggactgcatggaggacatggacggcagagcccccggcggcgccagcgtgcacaacgccatgcagctgaagcccggcaagcccaacggctggagaatccccttcaacagccactag

SEQ ID NO: 17761 - DNA, 735 bp, Artificial Sequence
  Description of Artificial Sequence: Synthetic coding sequence
atggcccccagacccctgggccccctggtgctggccctgggcggcgccgccgccgtgctgggcagcgtgctgttcatcctgtggaagacctacttcggcagaggcagagagagaagatgggacagaggcgaggcctggtggggcgccgaggccgccagactgcccgagtgggacgagtgggaccccgaggacgaggaggacgaggagcccgccctggaggagctggagcagagagaggtgctggtgctgggcctggacggcgccggcaagagcaccttcctgagagtgctgagcggcaagccccccctggagggccacatccccacctggggcttcaacagcgtgagactgcccaccaaggacttcgaggtggacctgctggagatcggcggcagccagaacctgagattctactggaaggagttcgtgagcgaggtggacgtgctggtgttcgtggtggacagcgccgacagactgagactgccctgggccagacaggagctgcacaagctgctggacaaggaccccgacctgcccgtggtggtggtggccaacaagcaggacctgagcgaggccatgagcatgggcgagctgcagagagagctgggcctgcaggccatcgacaaccagagagaggtgttcctgctggccgccagcatcgcccccgccggccccaccttcgaggagcccggcaccgtgcacatctggaagctgctgctggagctgctgagctag

SEQ ID NO: 17762 - DNA, 771 bp, Artificial Sequence
  Description of Artificial Sequence: Synthetic coding sequence
atgttcagactgctgagcagctgctgcagctgcctgagaaccaccgaggagaccagaagaaacgtgaccatccccatcatcggcctgaacaacagcggcaagaccgtgctggtggaggccttccagaagctgctgcccagcaagaccgaccactgcatgaagagcgagctgaccaccctgctgctggacgagtacgagctgagcatctacgacctgaacggcgacctgaagggcagagaggcctggcccaactactacgcccaggcccacggcctggtgttcgtgctggacagcagcgacatcagaagaatgcaggaggtgaagatcatcctgacccacctgctgagcgacaagagagtggccggcaagcccatcctgatcctggccaacaagcaggacaagaagaaggccctgatgccctgcgacatcatcgactacctgctgctgaagaagctggtgaaggagaacaagtgcccctgcagagtggagccctgcagcgccatcagaaacctggagagaagaaaccaccagcccatcgtggagggcctgagatggctgctggccgtgatcgacacctgccagctgccccccaccagcagcatcagcatcagcaagaacaacaccggcagcggcgagagatgcagcagccacagcttcagcaccagaaccggcatgagcaaggagaagagacagcacctggagcagtgcagcatcgaggccaagcccctgaagagcatcctgcagcccagcaaccagagctacacccactag

SEQ ID NO: 17763 - DNA, 873 bp, Artificial Sequence
  Description of Artificial Sequence: Synthetic coding sequence
atgttcagactgctgagcagctgctgcagctgcctgagaaccaccgaggagaccagaagaaacgtgaccatccccatcatcggcctgaacaacagcggcaagaccgtgctggtggaggccttccagaagctgctgcccagcaagaccgaccactgcatgaagagcgagctgaccaccctgctgctggacgagtacgagctgagcatctacgacctgaacggcgacctgaagggcagagaggcctggcccaactactacgcccaggcccacggcctggtgttcgtgctggacagcagcgacatcagaagaatgcaggaggtgaagatcatcctgacccacctgctgagcgacaagagagtggccggcaagcccatcctgatcctggccaacaagcaggacaagaagaaggccctgatgccctgcgacatcatcgactacctgctgctgaagaagctggtgaaggagaacaagtgcccctgcagagtggagccctgcagcgccatcagaaacctggagagaagaaaccaccagcccatcgtggagggcctgagatggctgctggccgtgatcgacacctgccagctgccccccaccagcagcatcagcatcagcaagaacaacaccggcagcggcgagagatgcagcagccacagcttcagcaccagaaccggcatgagcaaggagaagagacagcacctggagcagtgcagcatcgaggccaagcccctgaagagcatcctgcagaaggagggcaccagactgtggagcaagaagaacatgagcgtgaccttcgccctggacgagcccatgaaggagggcgagtgcagcagaagaatgagagcccagaacaccaccaagctgtgctacaactag

SEQ ID NO: 17764 - DNA, 594 bp, Artificial Sequence
  Description of Artificial Sequence: Synthetic coding sequence
atgagagtggccggcggcagagccctgagcagaggcgccgagctgagagtgcccggcggcgccaagcacggcatgtgcctgctgctgggcgccaccggcgtgggcaagaccctgctggtgaagagactgcaggaggtgagcagcagagacggcaagggcgacctgggcgagcccccccccaccagacccaccgtgggcaccaacctgaccgacatcgtggcccagagaaagatcaccatcagagagctgggcggctgcatgggccccatctggagcagctactacggcaactgcagaagcctgctgttcgtgatggacgccagcgaccccacccagctgagcgccagctgcgtgcagctgctgggcctgctgagcgccgagcagctggccgaggccagcgtgctgatcctgttcaacaagatcgacctgccctgctacatgagcaccgaggagatgaagagcctgatcagactgcccgacatcatcgcctgcgccaagcagaacatcaccaccgccgagatcagcgccagagagggcaccggcctggccggcgtgctggcctggctgcaggccacccacagagccaacgactag

SEQ ID NO: 17765 - DNA, 540 bp, Artificial Sequence
  Description of Artificial Sequence: Synthetic coding sequence
atgggccagctgatcgccaagctgatgagcatcttcggcaaccaggagcacaccgtgatcatcgtgggcctggacaacgagggcaagaccaccatcctgtacagattcctgaccaacgaggtggtgcacatgtgccccaccatcggcagcaacgtggaggagatcatcctgcccaagacccacttcttcatgtgggacatcgtgagacccgaggccctgagcttcatctggaacacctactacagcaacaccgagttcatcatcctggtgatcgacagcaccgacagagacagactgctgaccaccagagaggagctgtacaagatgctggcccacgaggccctgcaggacgccagcgtgctgatcttcgccaacaagcaggacgtgaaggacagcatgagaatggtggagatcagccacttcctgaccctgagcaccatcaaggaccacagctggcacatccagggctgctgcgccctgaccagagagggcctgcccgccagactgcagtggatggagagccaggccgccgccaactag

SEQ ID NO: 17766 - DNA, 540 bp, Artificial Sequence; identical to SEQ ID NO: 17765
  Description of Artificial Sequence: Synthetic coding sequence

SEQ ID NO: 17767 - DNA, 3936 bp, Artificial Sequence
  Description of Artificial Sequence: Synthetic coding sequence
atggacctgttcgacttcttcagagactgggacctggagcagcagtgccactacgagcaggacagaagcgccctgaagaagagagagtgggagagaagaaaccaggaggtgcagcaggaggacgacctgttcagcagcggcttcgacctgttcggcgagccctacaaggtggccgagtacaccaacaagggcgacgccctggccaacagagtgcagaacaccctgggcaactacgacgagatgaagaacctgctgaccaaccacagcaaccagaaccacctggtgggcatccccaagaacagcgtgccccagaaccccaacaacaagaacgagcccagcttcttccccgagcagaagaacagaatcatccccccccaccaggacaacacccaccccagcgcccccatgcccccccccagcgtggtgatcctgaacagcaccctgatccacagcaacagaaagagcaagcccgagtggagcagagacagccacaaccccagcaccgtgctggccagccaggccagcggccagcccaacaagatgcagaccctgacccaggaccagagccaggccaagctggaggacttcttcgtgtaccccgccgagcagccccagatcggcgaggtggaggagagcaaccccagcgccaaggaggacagcaaccccaacagcagcggcgaggacgccttcaaggagatcttccagagcaacagccccgaggagagcgagttcgccgtgcaggcccccggcagccccctggtggccagcagcctgctggcccccagcagcggcctgagcgtgcagaacttcccccccggcctgtactgcaagaccagcatgggccagcagaagcccaccgcctacgtgagacccatggacggccaggaccaggcccccgacatcagccccaccctgaagcccagcatcgagttcgagaacagcttcggcaacctgagcttcggcaccctgctggacggcaagcccagcgccgccagcagcaagaccaagctgcccaagttcaccatcctgcagaccagcgaggtgagcctgcccagcgaccccagctgcgtggaggagatcctgagagagatgacccacagctggcccacccccctgaccagcatgcacaccgccggccacagcgagcagagcaccttcagcatccccggccaggagagccagcacctgacccccggcttcaccctgcagaagtggaacgaccccaccaccagagccagcaccaagagcgtgagcttcaagagcatgctggaggacgacctgaagctgagcagcgacgaggacgacctggagcccgtgaagaccctgaccacccagtgcaccgccaccgagctgtaccaggccgtggagaaggccaagcccagaaacaaccccgtgaacccccccctggccaccccccagcccccccccgccgtgcaggccagcggcggcagcggcagcagcagcgagagcgagagcagcagcgagagcgacagcgacaccgagagcagcaccaccgacagcgagagcaacgaggcccccagagtggccacccccgagcccgagccccccagcaccaacaagtggcagctggacaagtggctgaacaaggtgaccagccagaacaagagcttcatctgcggccagaacgagacccccatggagaccatcagcctgcccccccccatcatccagcccatggaggtgcagatgaaggtgaagaccaacgccagccaggtgcccgccgagcccaaggagagacccctgctgagcctgatcagagagaaggccagacccagacccacccagaagatccccgagaccaaggccctgaagcacaagctgagcaccaccagcgagaccgtgagccagagaaccatcggcaagaagcagcccaagaaggtggagaagaacaccagcaccgacgagttcacctggcccaagcccaacatcaccagcagcacccccaaggagaaggagagcgtggagctgcacgacccccccagaggcagaaacaaggccaccgcccacaagcccgcccccagaaaggagcccagacccaacatccccctggcccccgagaagaagaagtacagaggccccggcaagatcgtgcccaagagcagagagttcatcgagaccgacagcagcaccagcgacagcaacaccgaccaggaggagaccctgcagatcaaggtgctgcccccctgcatcatcagcggcggcaacaccgccaagagcaaggagatctgcggcgccagcctgaccctgagcaccctgatgagcagcagcggcagcaacaacaacctgagcatcagcaacgaggagcccaccttcagccccatccccgtgatgcagaccgagatcctgagccccctgagagaccacgagaacctgaagaacctgtgggtgaagatcgacctggacctgctgagcagagtgcccggccacagcagcctgcacgccgcccccgccaagcccgaccacaaggagaccgccaccaagcccaagagacagaccgccgtgaccgccgtggagaagcccgcccccaagggcaagagaaagcacaagcccatcgaggtggccgagaagatccccgagaagaagcagagactggaggaggccaccaccatctgcctgctgcccccctgcatcagccccgcccccccccacaagccccccaacaccagagagaacaacagcagcagaagagccaacagaagaaaggaggagaagctgttccccccccccctgagccccctgcccgaggacccccccagaagaagaaacgtgagcggcaacaacggccccttcggccaggacaagaacatcgccatgaccggccagatcaccagcaccaagcccaagagaaccgagggcaagttctgcgccaccttcaagggcatcagcgtgaacgagggcgacacccccaagaaggccagcagcgccaccatcaccgtgaccaacaccgccatcgccaccgccaccgtgaccgccaccgccatcgtgaccaccaccgtgaccgccaccgccaccgccaccgccaccaccaccaccaccaccaccaccatcagcaccatcaccagcaccatcaccaccggcctgatggacagcagccacctggagatgaccagctgggccgccctgcccctgctgagcagcagcagcaccaacgtgagaagacccaagctgaccttcgacgacagcgtgcacaacgccgactactacatgcaggaggccaagaagctgaagcacaaggccgacgccctgttcgagaagttcggcaaggccgtgaactacgccgacgccgccctgagcttcaccgagtgcggcaacgccatggagagagaccccctggaggccaagagcccctacaccatgtacagcgagaccgtggagctgctgagatacgccatgagactgaagaacttcgccagccccctggccagcgacggcgacaagaagctggccgtgctgtgctacagatgcctgagcctgctgtacctgagaatgttcaagctgaagaaggaccacgccatgaagtacagcagaagcctgatggagtacttcaagcagaacgccagcaaggtggcccagatccccagcccctgggtgagcaacggcaagaacacccccagccccgtgagcctgaacaacgtgagccccatcaacgccatgggcaactgcaacaacggccccgtgaccatcccccagagaatccaccacatggccgccagccacgtgaacatcaccagcaacgtgctgagaggctacgagcactgggacatggccgacaagctgaccagagagaacaaggagttcttcggcgacctggacaccctgatgggccccctgacccagcacagcagcatgaccaacctggtgagatacgtgagacagggcctgtgctggctgagaatcgacgcccacctgctgtag

SEQ ID NO: 17768 - DNA, 3831 bp, Artificial Sequence
  Description of Artificial Sequence: Synthetic coding sequence
atggacctgttcgacttcttcagagactgggacctggagcagcagtgccactacgagcaggacagaagcgccctgaagaagagagagtgggagagaagaaaccaggaggtgcagcaggaggacgacctgttcagcagcggcttcgacctgttcggcgagccctacaagaccaacaagggcgacgccctggccaacagagtgcagaacaccctgggcaactacgacgagatgaagaacctgctgaccaaccacagcaaccagaaccacctggtgggcatccccaagaacagcgtgccccagaaccccaacaacaagaacgagcccagcttcttccccgagcagaagaacagaatcatccccccccaccaggacaacacccaccccagcgcccccatgcccccccccagcgtggtgatcctgaacagcaccctgatccacagcaacagaaagagcaagcccgagtggagcagagacagccacaaccccagcaccgtgctggccagccaggccagcggccagcccaacaagatgcagaccctgacccaggaccagagccaggccaagctggaggacttcttcgtgtaccccgccgagcagccccagatcggcgaggtggaggagagcaaccccagcgccaaggaggacagcaaccccaacagcagcggcgaggacgccttcaaggagatcttccagagcaacagccccgaggagagcgagttcgccgtgcaggcccccggcagccccctggtggccagcagcctgctggcccccagcagcggcctgagcgtgcagaacttcccccccggcctgtactgcaagaccagcatgggccagcagaagcccaccgcctacgtgagacccatggacggccaggaccaggcccccgacatcagccccaccctgaagcccagcatcgagttcgagaacagcttcggcaacctgagcttcggcaccctgctggacggcaagcccagcgccgccagcagcaagaccaagctgcccaagttcaccatcctgcagaccagcgaggtgagcctgcccagcgaccccagctgcgtggaggagatcctgagagagagccagcacctgacccccggcttcaccctgcagaagtggaacgaccccaccaccagagccagcaccaagagcgtgagcttcaagagcatgctggaggacgacctgaagctgagcagcgacgaggacgacctggagcccgtgaagaccctgaccacccagtgcaccgccaccgagctgtaccaggccgtggagaaggccaagcccagaaacaaccccgtgaacccccccctggccaccccccagcccccccccgccgtgcaggccagcggcggcagcggcagcagcagcgagagcgagagcagcagcgagagcgacagcgacaccgagagcagcaccaccgacagcgagagcaacgaggcccccagagtggccacccccgagcccgagccccccagcaccaacaagtggcagctggacaagtggctgaacaaggtgaccagccagaacaagagcttcatctgcggccagaacgagacccccatggagaccatcagcctgcccccccccatcatccagcccatggaggtgcagatgaaggtgaagaccaacgccagccaggtgcccgccgagcccaaggagagacccctgctgagcctgatcagagagaaggccagacccagacccacccagaagatccccgagaccaaggccctgaagcacaagctgagcaccaccagcgagaccgtgagccagagaaccatcggcaagaagcagcccaagaaggtggagaagaacaccagcaccgacgagttcacctggcccaagcccaacatcaccagcagcacccccaaggagaaggagagcgtggagctgcacgacccccccagaggcagaaacaaggccaccgcccacaagcccgcccccagaaaggagcccagacccaacatccccctggcccccgagaagaagaagtacagaggccccggcaagatcgtgcccaagagcagagagttcatcgagaccgacagcagcaccagcgacagcaacaccgaccaggaggagaccctgcagatcaaggtgctgcccccctgcatcatcagcggcggcaacaccgccaagagcaaggagatctgcggcgccagcctgaccctgagcaccctgatgagcagcagcggcagcaacaacaacctgagcatcagcaacgaggagcccaccttcagccccatccccgtgatgcagaccgagatcctgagccccctgagagaccacgagaacctgaagaacctgtgggtgaagatcgacctggacctgctgagcagagtgcccggccacagcagcctgcacgccgcccccgccaagcccgaccacaaggagaccgccaccaagcccaagagacagaccgccgtgaccgccgtggagaagcccgcccccaagggcaagagaaagcacaagcccatcgaggtggccgagaagatccccgagaagaagcagagactggaggaggccaccaccatctgcctgctgcccccctgcatcagccccgcccccccccacaagccccccaacaccagagagaacaacagcagcagaagagccaacagaagaaaggaggagaagctgttccccccccccctgagccccctgcccgaggacccccccagaagaagaaacgtgagcggcaacaacggccccttcggccaggacaagaacatcgccatgaccggccagatcaccagcaccaagcccaagagaaccgagggcaagttctgcgccaccttcaagggcatcagcgagggcgacacccccaagaaggccagcagcgccaccatcaccgtgaccaacaccgccatcgccaccgccaccgtgaccgccaccgccatcgtgaccaccaccgtgaccgccaccgccaccgccaccgccaccaccaccaccaccaccaccaccatcagcaccatcaccagcaccatcaccaccggcctgatggacagcagccacctggagatgaccagctgggccgccctgcccctgctgagcagcagcagcaccaacgtgagaagacccaagctgaccttcgacgacagcgtgcacaacgccgactactacatgcaggaggccaagaagctgaagcacaaggccgacgccctgttcgagaagttcggcaaggccgtgaactacgccgacgccgccctgagcttcaccgagtgcggcaacgccatggagagagaccccctggaggccaagagcccctacaccatgtacagcgagaccgtggagctgctgagatacgccatgagactgaagaacttcgccagccccctggccagcgacggcgacaagaagctggccgtgctgtgctacagatgcctgagcctgctgtacctgagaatgttcaagctgaagaaggaccacgccatgaagtacagcagaagcctgatggagtacttcaagcagaacgccagcaaggtggcccagatccccagcccctgggtgagcaacggcaagaacacccccagccccgtgagcctgaacaacgtgagccccatcaacgccatgggcaactgcaacaacggccccgtgaccatcccccagagaatccaccacatggccgccagccacgtgaacatcaccagcaacgtgctgagaggctacgagcactgggacatggccgacaagctgaccagagagaacaaggagttcttcggcgacctggacaccctgatgggccccctgacccagcacagcagcatgaccaacctggtgagatacgtgagacagggcctgtgctggctgagaatcgacgcccacctgctgtag

SEQ ID NO: 17769 - DNA, 1332 bp, Artificial Sequence
  Description of Artificial Sequence: Synthetic coding sequence
atgaccagacccagaaagcacgccgagaccctgggcggcggcaagctgtgcgacctgttctgcggcagacccggccaggtgagcagcagcagaggcagacagggcatccccgacatggagcccatcgtgcacatccaccaggagctgctgaccggcatcgagagcgaggccagcctgagcaagctgagccccaccagccagaagggcaccagcagcagcagcagctacatcttccagaagatcagccagggcaagcagatgtgccagaagctgaaggagcagaccgaccagctgaagaccaaggtgcaggagttcagcaagagaatcaagcaggacagcccctaccacctgcaggacaagaagctggtgctggagaagctgcagggccacctggagctgctggagcagaacttcctggccaccaaggacaagcacctgaccctgcagcagcaggtgcacaagcacgagagcaccatcgtgggcgacttcgaccccgagagaaaggtggagggcgagatcttcaagctggagatgctgctggaggacgtgaaggagaagatggacgagagcaagtacaccagcgcccccagcctgcccgtgagcagccccgtgaccctggacgacctggccagcaccttcagcagcctgagcaacgagatccccaaggagcaccccggccaccccagcggccccagaggcagcggcggcagcgaggtgaccggcaccccccagggcggcccccaggaggcccccaacgaggagctgtgcgagctggccccccagacctacctgaacggccactacggcgacgccgccgcccagaacaagcccgaccaggtggccatgagactgagcagcaacagcggcgaggaccccaacggcacccccagaagacaggactgcgccgagatgaccgcccccagccccagctgcgccttctgcagaagactgctggagtggaagcagaacgtggagaagaagggccacggcagaatcaactgcggcagattcagcatcgtgctgcacgagaaggccccccacagcgacagcacccccaacagcgacaccggccacagcttctgcagcgacagcggcaccgagatgcagagcaacaagtgccaggactgcggcaccaagatccccaccagcagaagagcctgcagaaaggagcccaccaaggagttccactacagatacaacacccccggccagaactacagcaaccacagcaagagaggcgccttcgtgcagccccacagcctggacgagagcaagaacagcagcccctgcaagtacatcagctgcatgacccccagcatcagcaccacctag

SEQ ID NO: 17770 - DNA, 2169 bp, Artificial Sequence
  Description of Artificial Sequence: Synthetic coding sequence
atggacgaggccgacttcagcgagcacaccacctacaagcaggaggacctgccctacgacggcgacctgagccagatcaagatcggcaacgactacagcttcaccagcaagaaggacggcctggaggtgctgaaccagatcatcttcatcgccgacgacccccaggagaaggccatgcacagcgagacctgcggcaacaccgccgtgaccatccccctgggcaagatcaccgagaacgccgccaacaagaaggacgagaaggagaagcagtgcaccgccgccctgcacatccccgccaacgagggcgacgccagcaagagcagcatcagcgacatcctgctgcaccacctgagcaaggagcccttcctgagaggccagggcatcgactgcgagaccctgcccgagatcagcaacgccgacagcttcgaggaggaggccatcatcaagagcatcatcagctgctacaacaagaacagctggcccaaggagcagacccccgagctgaccgaccagctgaaccccaagagagacggcgagaacagcaacaagcccggcagcgccaccaccaccgaggagaacaccagcgacctggagggccccgtggccgccggcgacagcagccaccaggagaacgtgaacgtgctgaccaagaccaagggccccggcgacaagcagaagagctaccagggccagagcccccagaagcagcagaccgagaaggccaacagcggcaacaccttcaagtacggccagggccaggtgcactaccagctgcccgacttcagcaagatcgcccccaaggtgaagatccccaagaacaagatcatcaacaagcccctggccatcgccaagcaggccagcttcagcagcaagagcagagacaagcccaccctggtgcaggacagcctggagaccacccccgagagcaactgcgtggagaagcagcaccaggagcagaagggcaagatcaccgagcccagccagcagatccagatggagcccatcgtgcacatccaccaggagctgctgaccggcatcgagagcgaggccagcctgagcaagctgagccccaccagccagaagggcaccagcagcagcagcagctacatcttccagaagatcagccagggcaagcagatgtgccagaagctgaaggagcagaccgaccagctgaagaccaaggtgcaggagttcagcaagagaatcaagcaggacagcccctaccacctgcaggacaagaagctggtgctggagaagctgcagggccacctggagctgctggagcagaacttcctggccaccaaggacaagcacctgaccctgcagcagcaggtgcacaagcacgagagcaccatcgtgggcgacttcgaccccgagagaaaggtggagggcgagatcttcaagctggagatgctgctggaggacgtgaaggagaagatggacgagagcaagtacaccagcgcccccagcctgcccgtgagcagccccgtgaccctggacgacctggccagcaccttcagcagcctgagcaacgaggcccccaacgaggagctgtgcgagctggccccccagacctacctgaacggccactacggcgacgccgccgcccagaacaagcccgaccaggtggccatgagactgagcagcaacagcggcgaggaccccaacggcacccccagaagacaggactgcgccgagatgaccgcccccagccccagctgcgccttctgcagaagactgctggagtggaagcagaacgtggagaagaagggccacggcagaatcaactgcggcagattcagcatcgtgctgcacgagaaggccccccacagcgacagcacccccaacagcgacaccggccacagcttctgcagcgacagcggcaccgagatgcagagcaacaagtgccaggactgcggcaccaagatccccaccagcagaagagcctgcagaaaggagcccaccaaggagttccactacagatacaacacccccggccagaactacagcaaccacagcaagagaggcgccttcgtgcagccccacagcctggacgagagcaagaacagcagcccctgcctggtgcacagccccgacaccagcaagagcagccccaccagcggctggcaggaggccgagctgggcctggagaacatgaagagccagtag

SEQ ID NO: 17771 - DNA, 2286 bp, Artificial Sequence
  Description of Artificial Sequence: Synthetic coding sequence
atggacgaggccgacttcagcgagcacaccacctacaagcaggaggacctgccctacgacggcgacctgagccagatcaagatcggcaacgactacagcttcaccagcaagaaggacggcctggaggtgctgaaccagatcatcttcatcgccgacgacccccaggagaaggccatgcacagcgagacctgcggcaacaccgccgtgaccatccccctgggcaagatcaccgagaacgccgccaacaagaaggacgagaaggagaagcagtgcaccgccgccctgcacatccccgccaacgagggcgacgccagcaagagcagcatcagcgacatcctgctgcaccacctgagcaaggagcccttcctgagaggccagggcatcgactgcgagaccctgcccgagatcagcaacgccgacagcttcgaggaggaggccatcatcaagagcatcatcagctgctacaacaagaacagctggcccaaggagcagacccccgagctgaccgaccagctgaaccccaagagagacggcgagaacagcaacaagcccggcagcgccaccaccaccgaggagaacaccagcgacctggagggccccgtggccgccggcgacagcagccaccaggagaacgtgaacgtgctgaccaagaccaagggccccggcgacaagcagaagagctaccagggccagagcccccagaagcagcagaccgagaaggccaacagcggcaacaccttcaagtacggccagggccaggtgcactaccagctgcccgacttcagcaagatcgcccccaaggtgaagatccccaagaacaagatcatcaacaagcccctggccatcgccaagcaggccagcttcagcagcaagagcagagacaagcccaccctggtgcaggacagcctggagaccacccccgagagcaactgcgtggagaagcagcaccaggagcagaagggcaagatcaccgagcccagccagcagatccagatggagcccatcgtgcacatccaccaggagctgctgaccggcatcgagagcgaggccagcctgagcaagctgagccccaccagccagaagggcaccagcagcagcagcagctacatcttccagaagatcagccagggcaagcagatgtgccagaagctgaaggagcagaccgaccagctgaagaccaaggtgcaggagttcagcaagagaatcaagcaggacagcccctaccacctgcaggacaagaagctggtgctggagaagctgcagggccacctggagctgctggagcagaacttcctggccaccaaggacaagcacctgaccctgcagcagcaggtgcacaagcacgagagcaccatcgtgggcgacttcgaccccgagagaaaggtggagggcgagatcttcaagctggagatgctgctggaggacgtgaaggagaagatggacgagagcaagtacaccagcgcccccagcctgcccgtgagcagccccgtgaccctggacgacctggccagcaccttcagcagcctgagcaacgagatccccaaggagcaccccggccaccccagcggccccagaggcagcggcggcagcgaggtgaccggcaccccccagggcggcccccaggaggcccccaacgaggagctgtgcgagctggccccccagacctacctgaacggccactacggcgacgccgccgcccagaacaagcccgaccaggtggccatgagactgagcagcaacagcggcgaggaccccaacggcacccccagaagacaggactgcgccgagatgaccgcccccagccccagctgcgccttctgcagaagactgctggagtggaagcagaacgtggagaagaagggccacggcagaatcaactgcggcagattcagcatcgtgctgcacgagaaggccccccacagcgacagcacccccaacagcgacaccggccacagcttctgcagcgacagcggcaccgagatgcagagcaacaagtgccaggactgcggcaccaagatccccaccagcagaagagcctgcagaaaggagcccaccaaggagttccactacagatacaacacccccggccagaactacagcaaccacagcaagagaggcgccttcgtgcagccccacagcctggacgagagcaagaacagcagccccagcctggccagccccttctgctgccccggcctggtgcacagccccgacaccagcaagagcagccccaccagcggctggcaggaggccgagctgggcctggagaacatgaagagccagtag

SEQ ID NO: 17772 - DNA, 2511 bp, Artificial Sequence
  Description of Artificial Sequence: Synthetic coding sequence
atggacgaggccgacttcagcgagcacaccacctacaagcaggaggacctgccctacgacggcgacctgagccagatcaagatcggcaacgactacagcttcaccagcaagaaggacggcctggaggtgctgaaccagatcatcttcatcgccgacgacccccaggagaaggccatgcacagcgagacctgcggcaacaccgccgtgaccatccccctgggcaagatcaccgagaacgccgccaacaagaaggacgagaaggagaagcagtgcaccgccgccctgcacatccccgccaacgagggcgacgccagcaagagcagcatcagcgacatcctgctgcaccacctgagcaaggagcccttcctgagaggccagggcatcgactgcgagaccctgcccgagatcagcaacgccgacagcttcgaggaggaggccatcatcaagagcatcatcagctgctacaacaagaacagctggcccaaggagcagacccccgagctgaccgaccagctgaaccccaagagagacggcgagaacagcaacaagcccggcagcgccaccaccaccgaggagaacaccagcgacctggagggccccgtggccgccggcgacagcagccaccaggagaacgtgaacgtgctgaccaagaccaagggccccggcgacaagcagaagagctaccagggccagagcccccagaagcagcagaccgagaaggccaacagcggcaacaccttcaagtacggccagggccaggtgcactaccagctgcccgacttcagcaagatcgcccccaaggtgaagatccccaagaacaagatcatcaacaagcccctggccatcgccaagcaggccagcttcagcagcaagagcagagacaagcccaccctggtgcaggacagcctggagaccacccccgagagcaactgcgtggagaagcagcaccaggagcagaagggcaagatcaccgagcccagccagcagatccagatggagcccatcgtgcacatccaccaggagctgctgaccggcatcgagagcgaggccagcctgagcaagctgagccccaccagccagaagggcaccagcagcagcagcagctacatcttccagaagatcagccagggcaagcagatgtgccagaagctgaaggagcagaccgaccagctgaagaccaaggtgcaggagttcagcaagagaatcaagcaggacagcccctaccacctgcaggacaagaagctggtgctggagaagctgcagggccacctggagctgctggagcagaacttcctggccaccaaggacaagcacctgaccctgcagcagcaggtgcacaagcacgagagcaccatcgtgggcgacttcgaccccgagagaaaggtggagggcgagatcttcaagctggagatgctgctggaggacgtgaaggagaagatggacgagagcaagtacaccagcgcccccagcctgcccgtgagcagccccgtgaccctggacgacctggccagcaccttcagcagcctgagcaacgagatccccaaggagcaccccggccaccccagcggccccagaggcagcggcggcagcgaggtgaccggcaccccccagggcggcccccaggaggcccccaacgaggagctgtgcgagctggccccccagacctacctgaacggccactacggcgacgccgccgcccagaacaagcccgaccaggtggccatgagactgagcagcaacagcggcgaggaccccaacggcacccccagaagacaggactgcgccgagatgaccgcccccagccccagctgcgccttctgcagaagactgctggagtggaagcagaacgtggagaagaagggccacggcagaatcaactgcggcagattcagcatcgtgctgcacgagaaggccccccacagcgacagcacccccaacagcgacaccggccacagcttctgcagcgacagcggcaccgagatgcagagcaacaagtgccaggactgcggcaccaagatccccaccagcagaagagcctgcagaaaggagcccaccaaggagttccactacagatacaacacccccggccagaactacagcaaccacagcaagagaggcgccttcgtgcagccccacagcctggacgagagcaagaacagcagccccagcttcctgaagcccaagagaatctgcagccagagagtgaacagcaagagcttcaagggcgagcacgagcccacccccggcaagaagaagctgcaggccttcatgacctacagcagcgaccccgccacccccagcccccacttctacagctgcagaatcagcggcagcaagagcctgtgcgacttcgacagcaccgaggagatcaagagcgagatcctgaacagcgccctggaccacgccctgagaaccgccaccatcctgaaggagaccaccgaccagatgatcaagaccatcgccgaggacctggccaaggcccagagatggagaaacagactgaagtactag

SEQ ID NO: 17773 - DNA, 1035 bp, Artificial Sequence
  Description of Artificial Sequence: Synthetic coding sequence
atggtgctgcagatggagccccaggtgaacagcaccaacaacttccaccagggccccctggaccagcccgtgggccccctgaccggcctgaagagcagcctgctgaaggacaccaccagcgccggccccctgctgagaccctaccccgccagcctgctgggcaaggtgaaggaggccgtgaaggtggccatcgacgccgagtacagacacatcgactgcgcctacttctacgagaaccagcacgaggtgggcgaggccatccaggagaagatccaggagaaggccgtgatgagagaggacctgttcatcgtgagcaaggtgtggcccaccttcttcgagagacccctggtgagaaaggccttcgagaagaccctgaaggacctgaagctgagctacctggacgtgtacctgatccactggccccagggcttcaagaccggcgacgacttcttccccaaggacgacaagggcaacatgatcagcggcaagggcaccttcctggacgcctgggaggccatggaggagctggtggacgagggcctggtgaaggccctgggcgtgagcaacttcaaccacttccagatcgagagactgctgaacaagcccggcctgaagtacaagcccgtgaccaaccaggtggagtgccacccctacctgacccaggagaagctgatccagtactgccacagcaagggcatcaccgtgaccgcctacagccccctgggcagccccgacagaccctgggccaagcccgaggaccccagcctgctggaggaccccaagatcaaggagatcgccgccaagcacaagaagaccaccgcccaggtgctgatcagattccacatccagagaaacgtgaccgtgatccccaagagcatgacccccgcccacatcgtggagaacatccaggtgttcgacttcaagctgagcgacgaggagatggccaccatcctgagcttcaacagaaactggagagccttcgacttcaaggagttcagccacctggaggacttccccttcgacgccgagtactag

SEQ ID NO: 17774 - DNA, 972 bp, Artificial Sequence
  Description of Artificial Sequence: Synthetic coding sequence
atggacagcaagtaccagtgcgtgaagctgaacgacggccacttcatgcccgtgctgggcttcggcacctacgcccccgccgaggtgcccaagagcaaggccctggaggccaccaagctggccatcgaggccggcttcagacacatcgacagcgcccacctgtacaacaacgaggagcaggtgggcctggccatcagaagcaagatcgccgacggcagcgtgaagagagaggacatcttctacaccagcaagctgtggtgcaacagccacagacccgagctggtgagacccgccctggagagaagcctgaagaacctgcagctggactacgtggacctgtacctgatccacttccccgtgagcgtgaagcccggcgaggaggtgatccccaaggacgagaacggcaagatcctgttcgacaccgtggacctgtgcgccacctgggaggccgtggagaagtgcaaggacgccggcctggccaagagcatcggcgtgagcaacttcaacagaagacagctggagatgatcctgaacaagcccggcctgaagtacaagcccgtgtgcaaccaggtggagtgccacccctacttcaaccagagaaagctgctggacttctgcaagagcaaggacatcgtgctggtggcctacagcgccctgggcagccacagagaggagccctgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccagcgaggagatgaaggccatcgacggcctgaacagaaacgtgagatacctgaccctggacatcttcgccggcccccccaactaccccttcagcgacgagtactag

SEQ ID NO: 17775 - DNA, 972 bp, Artificial Sequence
  Description of Artificial Sequence: Synthetic coding sequence
atggacagcaagtaccagtgcgtgaagctgaacgacggccacttcatgcccgtgctgggcttcggcacctacgcccccgccgaggtgcccaagagcaaggccctggaggccgtgaagctggccatcgaggccggcttccaccacatcgacagcgcccacgtgtacaacaacgaggagcaggtgggcctggccatcagaagcaagatcgccgacggcagcgtgaagagagaggacatcttctacaccagcaagctgtggagcaacagccacagacccgagctggtgagacccgccctggagagaagcctgaagaacctgcagctggactacgtggacctgtacctgatccacttccccgtgagcgtgaagcccggcgaggaggtgatccccaaggacgagaacggcaagatcctgttcgacaccgtggacctgtgcgccacctgggaggccatggagaagtgcaaggacgccggcctggccaagagcatcggcgtgagcaacttcaaccacagactgctggagatgatcctgaacaagcccggcctgaagtacaagcccgtgtgcaaccaggtggagtgccacccctacttcaaccagagaaagctgctggacttctgcaagagcaaggacatcgtgctggtggcctacagcgccctgggcagccacagagaggagccctgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccagcgaggagatgaaggccatcgacggcctgaacagaaacgtgagatacctgaccctggacatcttcgccggcccccccaactaccccttcagcgacgagtactag

SEQ ID NO: 17776 - DNA, 972 bp, Artificial Sequence
  Description of Artificial Sequence: Synthetic coding sequence
atggacagcaagcaccagtgcgtgaagctgaacgacggccacttcatgcccgtgctgggcttcggcacctacgccccccccgaggtgcccagaagcaaggccctggaggtgaccaagctggccatcgaggccggcttcagacacatcgacagcgcccacctgtacaacaacgaggagcaggtgggcctggccatcagaagcaagatcgccgacggcagcgtgaagagagaggacatcttctacaccagcaagctgtggagcaccttccacagacccgagctggtgagacccgccctggagaacagcctgaagaaggcccagctggactacgtggacctgtacctgatccacagccccatgagcctgaagcccggcgaggagctgagccccaccgacgagaacggcaaggtgatcttcgacatcgtggacctgtgcaccacctgggaggccatggagaagtgcaaggacgccggcctggccaagagcatcggcgtgagcaacttcaacagaagacagctggagatgatcctgaacaagcccggcctgaagtacaagcccgtgtgcaaccaggtggagtgccacccctacttcaacagaagcaagctgctggacttctgcaagagcaaggacatcgtgctggtggcctacagcgccctgggcagccagagagacaagagatgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccgccgaggacatgaaggccatcgacggcctggacagaaacctgcactacttcaacagcgacagcttcgccagccaccccaactacccctacagcgacgagtactag

SEQ ID NO: 17777 - DNA, 972 bp, Artificial Sequence
  Description of Artificial Sequence: Synthetic coding sequence
atggaccccaagtaccagagagtggagctgaacgacggccacttcatgcccgtgctgggcttcggcacctacgccccccccgaggtgcccagaaacagagccgtggaggtgaccaagctggccatcgaggccggcttcagacacatcgacagcgcctacctgtacaacaacgaggagcaggtgggcctggccatcagaagcaagatcgccgacggcagcgtgaagagagaggacatcttctacaccagcaagctgtggtgcaccttcttccagccccagatggtgcagcccgccctggagagcagcctgaagaagctgcagctggactacgtggacctgtacctgctgcacttccccatggccctgaagcccggcgagacccccctgcccaaggacgagaacggcaaggtgatcttcgacaccgtggacctgagcgccacctgggaggtgatggagaagtgcaaggacgccggcctggccaagagcatcggcgtgagcaacttcaactgcagacagctggagatgatcctgaacaagcccggcctgaagtacaagcccgtgtgcaaccaggtggagtgccacccctacctgaaccagagcaagctgctggacttctgcaagagcaaggacatcgtgctggtggcccacagcgccctgggcacccagagacacaagctgtgggtggaccccaacagccccgtgctgctggaggaccccgtgctgtgcgccctggccaagaagcacaagcagacccccgccctgatcgccctgagataccagctgcagagaggcgtggtggtgctggccaagagctacaacgagcagagaatcagagagaacatccaggtgttcgagttccagctgaccagcgaggacatgaaggtgctggacggcctgaacagaaactacagatacgtggtgatggacttcctgatggaccaccccgactaccccttcagcgacgagtactag

SEQ ID NO: 17778 - DNA, 972 bp, Artificial Sequence; identical to SEQ ID NO: 17777
  Description of Artificial Sequence: Synthetic coding sequence

SEQ ID NO: 17779 - DNA, 951 bp, Artificial Sequence
  Description of Artificial Sequence: Synthetic coding sequence
atggccaccttcgtggagctgagcaccaaggccaagatgcccatcgtgggcctgggcacctggagaagcctgctgggcaaggtgaaggaggccgtgaaggtggccatcgacgccgagtacagacacatcgactgcgcctacttctacgagaaccagcacgaggtgggcgaggccatccaggagaagatccaggagaaggccgtgatgagagaggacctgttcatcgtgagcaaggtgtggcccaccttcttcgagagacccctggtgagaaaggccttcgagaagaccctgaaggacctgaagctgagctacctggacgtgtacctgatccactggccccagggcttcaagaccggcgacgacttcttccccaaggacgacaagggcaacatgatcagcggcaagggcaccttcctggacgcctgggaggccatggaggagctggtggacgagggcctggtgaaggccctgggcgtgagcaacttcaaccacttccagatcgagagactgctgaacaagcccggcctgaagtacaagcccgtgaccaaccaggtggagtgccacccctacctgacccaggagaagctgatccagtactgccacagcaagggcatcaccgtgaccgcctacagccccctgggcagccccgacagaccctgggccaagcccgaggaccccagcctgctggaggaccccaagatcaaggagatcgccgccaagcacaagaagaccaccgcccaggtgctgatcagattccacatccagagaaacgtgaccgtgatccccaagagcatgacccccgcccacatcgtggagaacatccaggtgttcgacttcaagctgagcgacgaggagatggccaccatcctgagcttcaacagaaactggagagccttcgacttcaaggagttcagccacctggaggacttccccttcgacgccgagtactag

SEQ ID NO: 17780 - DNA, 84 bp, Artificial Sequence
  Description of Artificial Sequence: Synthetic coding sequence
aaccccaactggaagagaatcagactgaacgacggccccttcatgcccgtgctgggcttcggcacctacgcccccgaccactag

SEQ ID NO: 17781 - DNA, 462 bp, Artificial Sequence
  Description of Artificial Sequence: Synthetic coding sequence
atgcacctgaccaccgcccccagatggaagagacactgcgtgcccgccaccagctgcaccagaagagccagcagctggagcctggccagccccaccatgccccccggcaagtggcccagaagcgtgcccagcgccagagccaccgccggcagctgccccctgtgcaccagcttctggaaggagcaccacttcgagggcatcgccctggtggagaaggccctgcaggccgcctacggcgccagcgcccccagcatgaccagcgccgccctgagatggatgtaccaccacagccagctgcagggcgcccacggcgacgccgtgatcctgggcatgagcagcctggagcagctggagcagaacctggccgccgccgaggagggccccctggagcccgccgtggtggacgccttcaaccaggcctggcacctgttcgcccacgagtgccccaactacttcatctag

SEQ ID NO: 17782 - DNA, 903 bp, Artificial Sequence
  Description of Artificial Sequence: Synthetic coding sequence
atggagttccccttcgacgtggacgccctgttccccgagagaatcaccgtgctggaccagcacctgagaccccccgccagaagacccggcaccaccacccccgccagagtggacctgcagcagcagatcatgaccatcatcgacgagctgggcaaggccagcgccaaggcccagaacctgagcgcccccatcaccagcgccagcagaatgcagagcaacagacacgtggtgtacatcctgaaggacagcagcgccagacccgccggcaagggcgccatcatcggcttcatcaaggtgggctacaagaagctgttcgtgctggacgacagagaggcccacaacgaggtggagcccctgtgcatcctggacttctacatccacgagagcgtgcagagacacggccacggcagagagctgttccagtacatgctgcagaaggagagagtggagccccaccagctggccatcgacagacccagccagaagctgctgaagttcctgaacaagcactacaacctggagaccaccgtgccccaggtgaacaacttcgtgatcttcgagggcttcttcgcccaccagcacccccccgccagaaagctgccccccaagagagccgagggcgacatcaagccctacagcagcagcgacagagagttcctgaaggtggccgtggagcccccctggcccctgaacagagcccccagaagagccaccccccccgcccaccccccccccagaagcagcagcctgggcaacagccccgagagaggccccctgagacccttcgtgcccgagcaggagctgctgagaagcctgagactgtgccccccccaccccaccgccagactgctgctggccgccgaccccggcggcagccccgcccagagaagaagaaccagatag

SEQ ID NO: 17783 - DNA, 933 bp, Artificial Sequence
  Description of Artificial Sequence: Synthetic coding sequence
atggagttccccttcgacgtggacgccctgttccccgagagaatcaccgtgctggaccagcacctgagaccccccgccagaagacccggcaccaccacccccgccagagtggacctgcagcagcagatcatgaccatcatcgacgagctgggcaaggccagcgccaaggcccagaacctgagcgcccccatcaccagcgccagcagaatgcagagcaacagacacgtggtgtacatcctgaaggacagcagcgccagacccgccggcaagggcgccatcatcggcttcatcaaggtgggctacaagaagctgttcgtgctggacgacagagaggcccacaacgaggtggagcccctgtgcatcctggacttctacatccacgagagcgtgcagagacacggccacggcagagagctgttccagtacatgctgcagaaggagagagtggagccccaccagctggccatcgacagacccagccagaagctgctgaagttcctgaacaagcactacaacctggagaccaccgtgccccaggtgaacaacttcgtgatcttcgagggcttcttcgcccaccagcacccccccgccagaaagctgccccccaagagagccgagggcgacatcaagccctacagcagcagcgacagagagttcctgaaggtggccgtggagcccccctggcccctgaacagagcccccagaagagccaccccccccgcccaccccccccccagaagcagcagcctgggcaacagccccgagagaggccccctgagacccttcgtgcccgagcaggagctgctgagaagcctgagactgtgccccccccaccccaccgccagactgctgctggccgccgaccccggcggcagccccgcccagagaagaagaaccagcagcctgcccagaagcgaggagagcagatactag

SEQ ID NO: 17784 - DNA, 1002 bp, Artificial Sequence
  Description of Artificial Sequence: Synthetic coding sequence
atggagttccccttcgacgtggacgccctgttccccgagagaatcaccgtgctggaccagcacctgagaccccccgccagaagacccggcaccaccacccccgccagagtggacctgcagcagcagatcatgaccatcatcgacgagctgggcaaggccagcgccaaggcccagaacctgagcgcccccatcaccagcgccagcagaatgcagagcaacagacacgtggtgtacatcctgaaggacagcagcgccagacccgccggcaagggcgccatcatcggcttcatcaaggtgggctacaagaagctgttcgtgctggacgacagagaggcccacaacgaggtggagcccctgtgcatcctggacttctacatccacgagagcgtgcagagacacggccacggcagagagctgttccagtacatgctgcagaaggagagagtggagccccaccagctggccatcgacagacccagccagaagctgctgaagttcctgaacaagcactacaacctggagaccaccgtgccccaggtgaacaacttcgtgatcttcgagggcttcttcgcccaccagcacagaccccccgcccccagcctgagagccaccagacacagcagagccgccgccgtggaccccacccccgccgcccccgccagaaagctgccccccaagagagccgagggcgacatcaagccctacagcagcagcgacagagagttcctgaaggtggccgtggagcccccctggcccctgaacagagcccccagaagagccaccccccccgcccaccccccccccagaagcagcagcctgggcaacagccccgagagaggccccctgagacccttcgtgcccgagcaggagctgctgagaagcctgagactgtgccccccccaccccaccgccagactgctgctggccgccgaccccggcggcagccccgcccagagaagaagaaccagcagcctgcccagaagcgaggagagcagatactag

SEQ ID NO: 17785 - DNA, 1230 bp, Artificial Sequence
  Description of Artificial Sequence: Synthetic coding sequence
atgtggctgacctggcccttctgcttcctgaccatcaccctgagagaggagggcgtgtgccacctggagagcgtggacctgcagcagcagatcatgaccatcatcgacgagctgggcaaggccagcgccaaggcccagaacctgagcgcccccatcaccagcgccagcagaatgcagagcaacagacacgtggtgtacatcctgaaggacagcagcgccagacccgccggcaagggcgccatcatcggcttcatcaaggtgggctacaagaagctgttcgtgctggacgacagagaggcccacaacgaggtggagcccctgtgcatcctggacttctacatccacgagagcgtgcagagacacggccacggcagagagctgttccagtacatgctgcagaaggagagagtggagccccaccagctggccatcgacagacccagccagaagctgctgaagttcctgaacaagcactacaacctggagaccaccgtgccccaggtgaacaacttcgtgatcttcgagggcttcttcgcccaccagcacagaccccccgcccccagcctgagagccaccagacacagcagagccgccgccgtggaccccacccccgccgcccccgccagaaagctgccccccaagagagccgagggcgacatcaagccctacagcagcagcgacagagagttcctgaaggtggccgtggagcccccctggcccctgaacagagcccccagaagagccaccccccccgcccaccccccccccagaagcagcagcctgggcaacagccccgagagaggccccctgagacccttcgtgcccgagcaggagctgctgagaagcctgagactgtgccccccccaccccaccgccagactgctgctggccgccgaccccggcggcagccccgcccagagaagaagaaccagaggcaccccccccggcctggtggcccagagctgctgctacagcagacacggcggcgtgaacagcagcagccccaacaccggcaaccaggacagcaagcagggcgagcaggagaccaagaacagaagcgccagcgaggagcaggccctgagccaggacggcagcggcgagaagcccatgcacaccgcccccccccaggcccccgccccccccgcccagagctggaccgtgggcggcgacatcctgaacgccagattcatcagaaacctgcaggagagaagaagcaccagaccctggtag

SEQ ID NO: 17786 - DNA, 1197 bp, Artificial Sequence
  Description of Artificial Sequence: Synthetic coding sequence
atggagttccccttcgacgtggacgccctgttccccgagagaatcaccgtgctggaccagcacctgagaccccccgccagaagacccggcaccaccacccccgccagagtggacctgcagcagcagatcatgaccatcatcgacgagctgggcaaggccagcgccaaggcccagaacctgagcgcccccatcaccagcgccagcagaatgcagagcaacagacacgtggtgtacatcctgaaggacagcagcgccagacccgccggcaagggcgccatcatcggcttcatcaaggtgggctacaagaagctgttcgtgctggacgacagagaggcccacaacgaggtggagcccctgtgcatcctggacttctacatccacgagagcgtgcagagacacggccacggcagagagctgttccagtacatgctgcagaaggagagagtggagccccaccagctggccatcgacagacccagccagaagctgctgaagttcctgaacaagcactacaacctggagaccaccgtgccccaggtgaacaacttcgtgatcttcgagggcttcttcgcccaccagcacccccccgccagaaagctgccccccaagagagccgagggcgacatcaagccctacagcagcagcgacagagagttcctgaaggtggccgtggagcccccctggcccctgaacagagcccccagaagagccaccccccccgcccaccccccccccagaagcagcagcctgggcaacagccccgagagaggccccctgagacccttcgtgcccgagcaggagctgctgagaagcctgagactgtgccccccccaccccaccgccagactgctgctggccgccgaccccggcggcagccccgcccagagaagaagaaccagaggcaccccccccggcctggtggcccagagctgctgctacagcagacacggcggcgtgaacagcagcagccccaacaccggcaaccaggacagcaagcagggcgagcaggagaccaagaacagaagcgccagcgaggagcaggccctgagccaggacggcagcggcgagaagcccatgcacaccgcccccccccaggcccccgccccccccgcccagagctggaccgtgggcggcgacatcctgaacgccagattcatcagaaacctgcaggagagaagaagcaccagaccctggtag

SEQ ID NO: 17787 - DNA, 972 bp, Artificial Sequence
  Description of Artificial Sequence: Synthetic coding sequence
atggagttccccttcgacgtggacgccctgttccccgagagaatcaccgtgctggaccagcacctgagaccccccgccagaagacccggcaccaccacccccgccagagtggacctgcagcagcagatcatgaccatcatcgacgagctgggcaaggccagcgccaaggcccagaacctgagcgcccccatcaccagcgccagcagaatgcagagcaacagacacgtggtgtacatcctgaaggacagcagcgccagacccgccggcaagggcgccatcatcggcttcatcaaggtgggctacaagaagctgttcgtgctggacgacagagaggcccacaacgaggtggagcccctgtgcatcctggacttctacatccacgagagcgtgcagagacacggccacggcagagagctgttccagtacatgctgcagaaggagagagtggagccccaccagctggccatcgacagacccagccagaagctgctgaagttcctgaacaagcactacaacctggagaccaccgtgccccaggtgaacaacttcgtgatcttcgagggcttcttcgcccaccagcacagaccccccgcccccagcctgagagccaccagacacagcagagccgccgccgtggaccccacccccgccgcccccgccagaaagctgccccccaagagagccgagggcgacatcaagccctacagcagcagcgacagagagttcctgaaggtggccgtggagcccccctggcccctgaacagagcccccagaagagccaccccccccgcccaccccccccccagaagcagcagcctgggcaacagccccgagagaggccccctgagacccttcgtgcccgagcaggagctgctgagaagcctgagactgtgccccccccaccccaccgccagactgctgctggccgccgaccccggcggcagccccgcccagagaagaagaaccagatag

SEQ ID NO: 17788 - DNA, 1266 bp, Artificial Sequence
  Description of Artificial Sequence: Synthetic coding sequence
atggagttccccttcgacgtggacgccctgttccccgagagaatcaccgtgctggaccagcacctgagaccccccgccagaagacccggcaccaccacccccgccagagtggacctgcagcagcagatcatgaccatcatcgacgagctgggcaaggccagcgccaaggcccagaacctgagcgcccccatcaccagcgccagcagaatgcagagcaacagacacgtggtgtacatcctgaaggacagcagcgccagacccgccggcaagggcgccatcatcggcttcatcaaggtgggctacaagaagctgttcgtgctggacgacagagaggcccacaacgaggtggagcccctgtgcatcctggacttctacatccacgagagcgtgcagagacacggccacggcagagagctgttccagtacatgctgcagaaggagagagtggagccccaccagctggccatcgacagacccagccagaagctgctgaagttcctgaacaagcactacaacctggagaccaccgtgccccaggtgaacaacttcgtgatcttcgagggcttcttcgcccaccagcacagaccccccgcccccagcctgagagccaccagacacagcagagccgccgccgtggaccccacccccgccgcccccgccagaaagctgccccccaagagagccgagggcgacatcaagccctacagcagcagcgacagagagttcctgaaggtggccgtggagcccccctggcccctgaacagagcccccagaagagccaccccccccgcccaccccccccccagaagcagcagcctgggcaacagccccgagagaggccccctgagacccttcgtgcccgagcaggagctgctgagaagcctgagactgtgccccccccaccccaccgccagactgctgctggccgccgaccccggcggcagccccgcccagagaagaagaaccagaggcaccccccccggcctggtggcccagagctgctgctacagcagacacggcggcgtgaacagcagcagccccaacaccggcaaccaggacagcaagcagggcgagcaggagaccaagaacagaagcgccagcgaggagcaggccctgagccaggacggcagcggcgagaagcccatgcacaccgcccccccccaggcccccgccccccccgcccagagctggaccgtgggcggcgacatcctgaacgccagattcatcagaaacctgcaggagagaagaagcaccagaccctggtag

SEQ ID NO: 17789 - DNA, 1230 bp, Artificial Sequence; identical to SEQ ID NO: 17785
  Description of Artificial Sequence: Synthetic coding sequence

SEQ ID NO: 17790 - DNA, 1002 bp, Artificial Sequence; identical to SEQ ID NO: 17784
  Description of Artificial Sequence: Synthetic coding sequence

SEQ ID NO: 17791 - DNA, 903 bp, Artificial Sequence; identical to SEQ ID NO: 17782
  Description of Artificial Sequence: Synthetic coding sequence

SEQ ID NO: 17792 - DNA, 1266 bp, Artificial Sequence; identical to SEQ ID NO: 17788
  Description of Artificial Sequence: Synthetic coding sequence

SEQ ID NO: 17793 - DNA, 972 bp, Artificial Sequence; identical to SEQ ID NO: 17787
  Description of Artificial Sequence: Synthetic coding sequence

SEQ ID NO: 17794 - DNA, 933 bp, Artificial Sequence; identical to SEQ ID NO: 17783
  Description of Artificial Sequence: Synthetic coding sequence

SEQ ID NO: 17795 - DNA, 972 bp, Artificial Sequence; identical to SEQ ID NO: 17787
  Description of Artificial Sequence: Synthetic coding sequence

SEQ ID NO: 17796 - DNA, 1230 bp, Artificial Sequence; identical to SEQ ID NO: 17785
  Description of Artificial Sequence: Synthetic coding sequence

SEQ ID NO: 17797 - DNA, 903 bp, Artificial Sequence; identical to SEQ ID NO: 17782
  Description of Artificial Sequence: Synthetic coding sequence

SEQ ID NO: 17798 - DNA, 903 bp, Artificial Sequence; identical to SEQ ID NO: 17782
  Description of Artificial Sequence: Synthetic coding sequence

SEQ ID NO: 17799 - DNA, 972 bp, Artificial Sequence; identical to SEQ ID NO: 17787
  Description of Artificial Sequence: Synthetic coding sequence

SEQ ID NO: 17800 - DNA, 1266 bp, Artificial Sequence; identical to SEQ ID NO: 17788
  Description of Artificial Sequence: Synthetic coding sequence

SEQ ID NO: 17801 - DNA, 903 bp, Artificial Sequence; identical to SEQ ID NO: 17782
  Description of Artificial Sequence: Synthetic coding sequence

SEQ ID NO: 17802 - DNA, 972 bp, Artificial Sequence; identical to SEQ ID NO: 17787
  Description of Artificial Sequence: Synthetic coding sequence

SEQ ID NO: 17803 - DNA, 933 bp, Artificial Sequence; identical to SEQ ID NO: 17783
  Description of Artificial Sequence: Synthetic coding sequence

SEQ ID NO: 17804 - DNA, 1230 bp, Artificial Sequence; identical to SEQ ID NO: 17785
  Description of Artificial Sequence: Synthetic coding sequence

SEQ ID NO: 17805 - DNA, 1002 bp, Artificial Sequence; identical to SEQ ID NO: 17784
  Description of Artificial Sequence: Synthetic coding sequence

SEQ ID NO: 17806 - DNA, 933 bp, Artificial Sequence; identical to SEQ ID NO: 17783
  Description of Artificial Sequence: Synthetic coding sequence

SEQ ID NO: 17807 - DNA, 1266 bp, Artificial Sequence; identical to SEQ ID NO: 17788
  Description of Artificial Sequence: Synthetic coding sequence

SEQ ID NO: 17808 - DNA, 1230 bp, Artificial Sequence; identical to SEQ ID NO: 17785
  Description of Artificial Sequence: Synthetic coding sequence

SEQ ID NO: 17809 - DNA, 1266 bp, Artificial Sequence; identical to SEQ ID NO: 17788
  Description of Artificial Sequence: Synthetic coding sequence

SEQ ID NO: 17810 - DNA, 903 bp, Artificial Sequence; identical to SEQ ID NO: 17782
  Description of Artificial Sequence: Synthetic coding sequence

SEQ ID NO: 17811 - DNA, 933 bp, Artificial Sequence; identical to SEQ ID NO: 17783
  Description of Artificial Sequence: Synthetic coding sequence

SEQ ID NO: 17812 - DNA, 1266 bp, Artificial Sequence; identical to SEQ ID NO: 17788
  Description of Artificial Sequence: Synthetic coding sequence

SEQ ID NO: 17813 - DNA, 933 bp, Artificial Sequence; identical to SEQ ID NO: 17783
  Description of Artificial Sequence: Synthetic coding sequence

SEQ ID NO: 17814 - DNA, 972 bp, Artificial Sequence; identical to SEQ ID NO: 17787
  Description of Artificial Sequence: Synthetic coding sequence

SEQ ID NO: 17815 - DNA, 1230 bp, Artificial Sequence; identical to SEQ ID NO: 17785
  Description of Artificial Sequence: Synthetic coding sequence

SEQ ID NO: 17816 - DNA, 903 bp, Artificial Sequence; identical to SEQ ID NO: 17782
  Description of Artificial Sequence: Synthetic coding sequence

SEQ ID NO: 17817 - DNA, 1002 bp, Artificial Sequence; identical to SEQ ID NO: 17784
  Description of Artificial Sequence: Synthetic coding sequence

SEQ ID NO: 17818 - DNA, 1002 bp, Artificial Sequence; identical to SEQ ID NO: 17784
  Description of Artificial Sequence: Synthetic coding sequence

SEQ ID NO: 17819 - DNA, 1266 bp, Artificial Sequence; identical to SEQ ID NO: 17788
  Description of Artificial Sequence: Synthetic coding sequence

SEQ ID NO: 17820 - DNA, 933 bp, Artificial Sequence; identical to SEQ ID NO: 17783
  Description of Artificial Sequence: Synthetic coding sequence

SEQ ID NO: 17821 - DNA, 1002 bp, Artificial Sequence; identical to SEQ ID NO: 17784
  Description of Artificial Sequence: Synthetic coding sequence

SEQ ID NO: 17822 - DNA, 1002 bp, Artificial Sequence; identical to SEQ ID NO: 17784
  Description of Artificial Sequence: Synthetic coding sequence

SEQ ID NO: 17823 - DNA, 972 bp, Artificial Sequence; identical to SEQ ID NO: 17787
  Description of Artificial Sequence: Synthetic coding sequence

SEQ ID NO: 17824 - DNA, 1230 bp, Artificial Sequence; identical to SEQ ID NO: 17785
  Description of Artificial Sequence: Synthetic coding sequence

SEQ ID NO: 17825 - DNA, 1197 bp, Artificial Sequence; identical to SEQ ID NO: 17786
  Description of Artificial Sequence: Synthetic coding sequence

SEQ ID NO: 17826 - DNA, 1197 bp, Artificial Sequence; identical to SEQ ID NO: 17786
  Description of Artificial Sequence: Synthetic coding sequence

SEQ ID NO: 17827 - DNA, 1197 bp, Artificial Sequence; identical to SEQ ID NO: 17786
  Description of Artificial Sequence: Synthetic coding sequence

SEQ ID NO: 17828 - DNA, 1197 bp, Artificial Sequence; identical to SEQ ID NO: 17786
  Description of Artificial Sequence: Synthetic coding sequence

SEQ ID NO: 17829 - DNA, 1197 bp, Artificial Sequence; identical to SEQ ID NO: 17786
  Description of Artificial Sequence: Synthetic coding sequence

SEQ ID NO: 17830 - DNA, 1197 bp, Artificial Sequence; identical to SEQ ID NO: 17786
  Description of Artificial Sequence: Synthetic coding sequence

SEQ ID NO: 17831 - DNA, 618 bp, Artificial Sequence
  Description of Artificial Sequence: Synthetic coding sequence
atgagcttcgccaccaagttcagcgactacttcctgctgatcgaggacaacgtgttcttcgcccccaacttcgtgacccacatccacagcagagtgaccaccatgaagagcaacagctgggtgctgatggagttcagcaacatgggcttcctgggcaagctgttccacagcagagacctgcccctgctggcccacttcctgctgctgttctacaaggagaagcccctggacagcctgatcagccacttccacaccctgctggtgcaggagagccccatcctgtgcagacccttcctgttctactgcagagtgagctacaccgccttcgaccacaagcagaaggccaccgccctgcagaagaagaacgccgacggccccaacaacccccccggcgccgtgttcaccgacatgcaggtgagcgacgtgcacttcccctgggaggcctacaccctggacgagagcttcttctggacccacaacatcagcatcggcaaccacctgaccgtgatcctgaaccaccccgccaacctgagcagagtgcaggtgatgaccggcagcatcgtggagtgggaggtgagacccggcgagggcgccggcggcgccggcctgcccacctag

SEQ ID NO: 17832 - DNA, 618 bp, Artificial Sequence; identical to SEQ ID NO: 17831
  Description of Artificial Sequence: Synthetic coding sequence

SEQ ID NO: 17833 - DNA, 6513 bp, Artificial Sequence
  Description of Artificial Sequence: Synthetic coding sequence
atgaaggacagcgagggcccccagagaccccccctgtgcttcctgagcaccctgctgagccagaaggtgcccgagaagagcgacgccgtgctgagatgcatcatcagcggccagcccaagcccgaggtgacctggtacaagaacggccaggccatcgacggcagcggcatcatcagcaactacgagttcttcgagaaccagtacatccacgtgctgcacctgagctgctgcaccaagaacgacgccgccgtgtaccagatcagcgccaagaacagcttcggcatgatctgctgcagcgccagcgtggaggtggagtgcagcagcgagaacccccagctgagccccaacctggaggacgacagagacagaggctggaagcacgagaccggcacccacgaggaggagagagccaaccagatcgacgagaaggagcacccctacaaggaggaggagagcatcagccccggcacccccagaagcgccgacagcagccccagcaagagcaaccacagcctgagcctgcagagcctgggcaacctggacatcagcgtgagcagcagcgagaaccccctgggcgtgaagggcaccagacacaccggcgaggcctacgaccccagcaacaccgaggagatcgccaacggcctgctgttcctgaacagcagccacatctacgagaagcaggacagatgctgccacaagaccgtgcacagcatggccagcaagttcaccgacggcgacctgaacaacgacggcccccacgacgagggcctgagaagcagccagcagaaccccaaggtgcagaagtacatcagcttcagcctgcccctgagcgaggccaccgcccacatctaccccggcgacagcgccgtggccaacaagcagcccagcccccagctgagcagcgaggacagcgacagcgactacgagctgtgccccgagatcaccctgacctacaccgaggagttcagcgacgacgacctggagtacctggagtgcagcgacgtgatgaccgactacagcaacgccgtgtggcagagaaacctgctgggcaccgagcacgtgttcctgctggagagcgacgacgaggagatggagttcggcgagcactgcctgggcggctgcgagcacttcctgagcggcatgggctgcggcagcagagtgagcggcgacgccggccccatggtggccaccgccggcttctgcggccaccacagccagccccaggaggtgggcgtgagaagcagcagagtgagcaagcacggccccagcagcccccagaccggcatgaccctgatcctgggcccccaccaggacggcaccagcagcgtgaccgagcagggcagatacaagctgcccaccgcccccgaggccgccgagaacgactaccccggcatccagggcgagaccagagacagccaccaggccagagaggagttcgccagcgacaacctgctgaacatggacgagagcgtgagagagaccgagatgaagctgctgagcggcgagagcgagaacagcggcatgagccagtgctgggagaccgccgccgacaagagagtgggcggcaaggacctgtggagcaagagaggcagcagaaagagcgccagagtgagacagcccggcatgaagggcaaccccaagaagcccaacgccaacctgagagagagcaccaccgagggcaccctgcacctgtgcagcgccaaggagagcgccgagccccccctgacccagagcgacaagagagagaccagccacaccaccgccgccgccaccggcagaagcagccacgccgacgccagagagtgcgccatcagcacccaggccgagcaggaggccaagaccctgcagaccagcaccgacagcgtgagcaaggagggcaacaccaactgcaagggcgagggcatgcaggtgaacaccctgttcgagaccagccaggtgcccgactggagcgaccccccccaggtgcaggtgcaggagaccgtgagagagaccatcagctgcagccagatgcccgccttcagcgagcccgccggcgaggagagccccttcaccggcaccaccaccatcagcttcagcaacctgggcggcgtgcacaaggagaacgccagcctggcccagcacagcgaggtgaagccctgcacctgcggcccccagcacgaggagaagcaggacagagacggcaacatccccgacaacttcagagaggacctgaagtacgagcagagcatcagcgaggccaacgacgagaccatgagccccggcgtgttcagcagacacctgcccaaggacgccagagccgacttcagagagcccgtggccgtgagcgtggccagccccgagcccaccgacaccgccctgaccctggagaacgtgtgcgacgagcccagagacagagaggccgtgtgcgccatggagtgcttcgaggccggcgaccagggcacctgcttcgacaccatcgacagcctggtgggcagacccgtggacaagtacagcccccaggagatctgcagcgtggacaccgagctggccgagggccagaacaaggtgagcgacctgtgcagcagcaacgacaagaccctggaggtgttcttccagacccaggtgagcgagaccagcgtgagcacctgcaagagcagcaaggacggcaacagcgtgatgagccccctgttcaccagcaccttcaccctgaacatcagccacaccgccagcgagggcgccaccggcgagaacctggccaaggtggagaacagcacctaccccctggccagcaccgtgcacgccggccaggagcagcccagccccagcaacagcggcggcctggacgagacccagctgctgagcagcgagaacaaccccctggtgcagttcaaggagggcggcgacaagagccccagccccagcgccgccgacaccaccgccacccccgccagctacagcagcatcgtgagcttcccctgggagaagcccaccaccctgaccgccaacaacgagtgcttccaggccaccagagagaccgaggacaccagcaccgtgaccatcgccaccgaggtgcaccccgccaagtacctggccgtgagcatccccgaggacaagcacgccggcggcaccgaggagagattccccagagccagccacgagaaggtgagccagttccccagccaggtgcagctggaccacatcctgagcggcgccaccatcaagagcaccaaggagctgctgtgcagagcccccagcgtgcccggcgtgccccaccacgtgctgcagctgcccgagggcgagggcttctgcagcaacagccccctgcaggtggacaacctgagcggcgacaagagccagaccgtggacagagccgacttcagaagctacgaggagaacttccaggagagaggcagcgagaccaagcagggcgtgcagcagcagagcctgagccagcagggcagcctgagcgcccccgacttccagcagagcctgcccaccaccagcgccgcccaggaggagagaaacctggtgcccaccgcccacagccccgccagcagcagagagggcgccggccagagaagcggctggggcaccagagtgagcgtggtggccgagaccgccggcgaggaggacagccaggccctgagcaacgtgcccagcctgagcgacatcctgctggaggagagcaaggagtacagacccggcaactgggaggccggcaacaagctgaagatcatcaccctggaggccagcgccagcgagatctggccccccagacagctgaccaacagcgagagcaaggccagcgacggcggcctgatcatccccgacaaggtgtgggccgtgcccgacagcctgaaggccgacgccgtggtgcccgagctggcccccagcgagatcgccgccctggcccacagccccgaggacgccgagagcgccctggccgacagcagagagagccacaagggcgaggagcccaccatcagcgtgcactggagaagcctgagcagcagaggcttcagccagcccagactgctggagagcagcgtggaccccgtggacgagaaggagctgagcgtgaccgacagcctgagcgccgccagcgagaccggcggcaaggagaacgtgaacaacgtgagccaggaccaggaggagaagcagctgaagatggaccacaccgccttcttcaagaagttcctgacctgccccaagatcctggagagcagcgtggaccccatcgacgagatcagcgtgatcgagtacaccagagccggcaagcccgagcccagcgagaccaccccccagggcgccagagagggcggccagagcaacgacggcaacatgggccacgaggccgagatccagcccgccatcctgcaggtgccctgcctgcagggcaccatcctgagcgagaacagaatcagcagaagccaggagggcagcatgaagcaggaggccgagcagatccagcccgaggaggccaagaccgccatctggcaggtgctgcagcccagcgagggcggcgagagaatccccagcggctgcagcatcggccagatccaggagagcagcgacggcagcctgggcgaggccgagcagagcaagaaggacaaggccgagctgatcagccccaccagccccctgagcagctgcctgcccatcatgacccacgccagcctgggcgtggacacccacaacagcaccggccagatccacgacgtgcccgagaacgacatcgtggagcccagaaagagacagtacgtgttccccgtgagccagaagagaggcaccatcgagaacgagagaggcaagcccctgcccagcagccccgacctgaccagattcccctgcaccagcagccccgagggcaacgtgaccgacttcctgatcagccacaagatggaggagcccaagatcgaggtgctgcagatcggcgagaccaagccccccagcagcagcagcagcagcgccaagaccctggccttcatcagcggcgagagagagctggagaaggcccccaagctgctgcaggacccctgccagaagggcaccctgggctgcgccaagaagagcagagagagagagaagagcctggaggccagagccggcaagagccccggcaccctgaccgccgtgaccggcagcgaggaggtgaagagaaagcccgaggcccccggcagcggccacctggccgagggcgtgaagaagaagatcctgagcagagtggccgccctgagactgaagctggaggagaaggagaacatcagaaagaacagcgccttcctgaagaagatgcccaagctggagaccagcctgagccacaccgaggagaagcaggaccccaagaagcccagctgcaagagagagggcagagcccccgtgctgctgaagaagatccaggccgagatgttccccgagcacagcggcaacgtgaagctgagctgccagttcgccgagatccacgaggacagcaccatctgctggaccaaggacagcaagagcatcgcccaggtgcagagaagcgccggcgacaacagcaccgtgagcttcgccatcgtgcaggccagccccaaggaccagggcctgtactactgctgcatcaagaacagctacggcaaggtgaccgccgagttcaacctgaccgccgaggtgctgaagcagctgagcagcagacaggacaccaagggctgcgaggagatcgagttcagccagctgatcttcaaggaggacttcctgcacgacagctacttcggcggcagactgagaggccagatcgccaccgaggagctgcacttcggcgagggcgtgcacagaaaggccttcagaagcaccgtgatgcacggcctgatgcccgtgttcaagcccggccacgcctgcgtgctgaaggtgcacaacgccatcgcctacggcaccagaaacaacgacgagctgatccagagaaactacaagctggccgcccaggagtgctacgtgcagaacaccgccagatactacgccaagatctacgccgccgaggcccagcccctggagggcttcggcgaggtgcccgagatcatccccatcttcctgatccacagacccgagaacaacatcccctacgccaccgtggaggaggagctgatcggcgagttcgtgaagtacagcatcagagacggcaaggagatcaacttcctgagaagagagagcgaggccggccagaagtgctgcaccttccagcactgggtgtaccagaagaccagcggctgcctgctggtgaccgacatgcagggcgtgggcatgaagctgaccgacgtgggcatcgccaccctggccaagggctacaagggcttcaagggcaactgcagcatgaccttcatcgaccagttcaaggccctgcaccagtgcaacaagtactgcaagatgctgggcctgaagagcctgcagaacaacaaccagaagcagaagcagcccagcatcggcaagagcaaggtgcagaccaacagcatgaccatcaagaaggccggccccgagacccccggcgagaagaagacctag

SEQ ID NO: 17834 - DNA, 1230 bp, Artificial Sequence
  Description of Artificial Sequence: Synthetic coding sequence
atgagaggcgagcagggcgccgccggcgccagagtgctgcagttcaccaactgcagaatcctgagaggcggcaagctgctgagagaggacctgtgggtgagaggcggcagaatcctggaccccgagaagctgttcttcgaggagagaagagtggccgacgagagaagagactgcggcggcagaatcctggcccccggcttcatcgacgtgcagatcaacggcggcttcggcgtggacttcagccaggccaccgaggacgtgggcagcggcgtggccctggtggccagaagaatcctgagccacggcgtgaccagcttctgccccaccctggtgaccagcccccccgaggtgtaccacaaggtggtgccccagatccccgtgaagagcggcggcccccacggcgccggcgtgctgggcctgcacctggagggccccttcatcagcagagagaagagaggcgcccaccccgaggcccacctgagaagcttcgaggccgacgccttccaggacctgctggccacctacggccccctggacaacgtgagaatcgtgaccctggcccccgagctgggcagaagccacgaggtgatcagagccctgaccgccagaggcatctgcgtgagcctgggccacagcgtggccgacctgagagccgccgaggacgccgtgtggagcggcgccaccttcatcacccacctgttcaacgccatgctgcccttccaccacagagaccccggcatcgtgggcctgctgaccagcgacagactgcccgccggcagatgcatcttctacggcatgatcgccgacggcacccacaccaaccccgccgccctgagaatcgcccacagagcccacccccagggcctggtgctggtgaccgacgccatccccgccctgggcctgggcaacggcagacacaccctgggccagcaggaggtggaggtggacggcctgaccgcctacgtggccggcaccaagaccctgagcggcagcatcgcccccatggacgtgtgcgtgagacacttcctgcaggccaccggctgcagcatggagagcgccctggaggccgccagcctgcaccccgcccagctgctgggcctggagaagagcaagggcaccctggacttcggcgccgacgccgacttcgtggtgctggacgacagcctgcacgtgcaggccacctacatcagcggcgagctggtgtggcaggccgacgccgccagacagtag

SEQ ID NO: 17835 - DNA, 1320 bp, Artificial Sequence
  Description of Artificial Sequence: Synthetic coding sequence
atgagaggcgagcagggcgccgccggcgccagagtgctgcagttcaccaactgcagaatcctgagaggcggcaagctgctgagagaggacctgtgggtgagaggcggcagaatcctggaccccgagaagctgttcttcgaggagagaagagtggccgacgagagaagagactgcggcggcagaatcctggcccccggcttcatcgacgtgcagatcaacggcggcttcggcgtggacttcagccaggccaccgaggacgtgggcagcggcgtggccctggtggccagaagaatcctgagccacggcgtgaccagcttctgccccaccctggtgaccagcccccccgaggtgtaccacaaggtggtgccccagatccccgtgaagagcggcggcccccacggcgccggcgtgctgggcctgcacctggagggccccttcatcagcagagagaagagaggcgcccaccccgaggcccacctgagaagcttcgaggccgacgccttccaggacctgctggccacctacggccccctggacaacgtgagaatcgtgaccctggcccccgagctgggcagaagccacgaggtgatcagagccctgaccgccagaggcatctgcgtgagcctgggccacagcgtggccgacctgagagccgccgaggacgccgtgtggagcggcgccaccttcatcacccacctgttcaacgccatgctgcccttccaccacagagaccccggcatcgtgggcctgctgaccagcgacagactgcccgccggcagatgcatcttctacggcatgatcgccgacggcacccacaccaaccccgccgccctgagaatcgcccacagagcccacccccagggcctggtgctggtgaccgacgccatccccgccctgggcctgggcaacggcagacacaccctgggccagcaggaggtggaggtggacggcctgaccgcctacgtggccggcgagagacccgaccccctgggccccagaagccagcccgcctgccaggtggcccacgacccccccagagcctgccccctgtgcagccagggcaccaagaccctgagcggcagcatcgcccccatggacgtgtgcgtgagacacttcctgcaggccaccggctgcagcatggagagcgccctggaggccgccagcctgcaccccgcccagctgctgggcctggagaagagcaagggcaccctggacttcggcgccgacgccgacttcgtggtgctggacgacagcctgcacgtgcaggccacctacatcagcggcgagctggtgtggcaggccgacgccgccagacagtag

SEQ ID NO: 17836 - DNA, 1785 bp, Artificial Sequence
  Description of Artificial Sequence: Synthetic coding sequence
atgagaggcgagcagggcgccgccggcgccagagtgctgcagttcaccaactgcagaatcctgagaggcggcaagctgctgagagaggacctgtgggtgagaggcggcagaatcctggaccccgagaagctgttcttcgaggagagaagagtggccgacgagagaagagactgcggcggcagaatcctggcccccggcttcatcgacgtgcagatcaacggcggcttcggcgtggacttcagccaggccaccgaggacgtgggcagcggcgtggccctggtggccagaagaatcctgagccacggcgtgaccagcttctgccccaccctggtgaccagcccccccgaggtgtaccacaaggtggtgccccagatccccgtgaagagcggcggcccccacggcgccggcgtgctgggcctgcacctggagggccccttcatcagcagagagaagagaggcgcccaccccgaggcccacctgagaagcttcgaggccgacgccttccaggacctgctggccacctacggccccctggacaacgtgagaatcgtgaccctggcccccgagctgggcagaagccacgaggtgatcagagccctgaccgccagaggcatctgcgtgagcctgggccacagcgtggccgacctgagagccgccgaggacgccgtgtggagcggcgccaccttcatcacccacctgttcaacgccatgctgcccttccaccacagagaccccggcatcgtgggcctgctgaccagcgacagactgcccgccggcagatgcatcttctacggcatgatcgccgacggcacccacaccaaccccgccgccctgagaatcgcccacagagcccacccccagggcctggtgctggtgaccgacgccatccccgccctgggcctgggcaacggcagacacaccctgggccagcaggaggtggaggtggacggcctgaccgcctacgtggccggcgagagacccgaccccctgggccccagaagccagcccgcctgccaggtggcccacgacccccccagagcctgccccctgtgcagccagggcaccaagaccctgagcggcagcatcgcccccatggacgtgtgcgtgagacacttcctgcaggccaccggctgcagcatggagagcgccctggaggccgccagcctgcaccccgcccagctgctgggcctggagaagagcaagggcaccctggacttcggcgccgacgccgacttcgtggtgctggacgacagcctgcacgtgcaggccacctacatcagcggccccgtgctggccggctgcggcgaccccgcctggtgctggagagccgtgtgggaggcccccgtgtgccccgcccaccccatcagcgtgatcctgcccagcagcgtgagcccctggccctggcacacccccatgtggcagaccagagccgtgagactgcccgagcagctgagaggcggctgggccagcggcgccctgctggccctgagaaccgccaccgtgggcagcgacgtgagagactggtgcagccccaccagcggcgtgatcgtgctgaccttcagccccttcgagttctggggcggctggctgcccagccccctgctgaccggcgccgtgctgggcaccggcggcaccagactggccctgcccctgttcagcagcctgtgctgcaaggcccagctgagaaagtgcctgcaggtgcagagagacagaatggtgtgggccccccccgtgggcagagagcagcccggcaagaaccacctgcccggccagggcctggcctag

SEQ ID NO: 17837 - DNA, 933 bp, Artificial Sequence
  Description of Artificial Sequence: Synthetic coding sequence
atgggcaagagaagatgcgtgccccccctggagcccaagctggccgccggctgctgcggcgtgaagaagcccaagctgagcggcagcggcacccacagccacggcaaccagagcaccaccgtgcccggcagcagcagcggccccctgcagaaccaccagcacgtggacagcagcagcggcagagagaacgtgagcgacctgaccctgggccccggcaacagccccatcaccagaatgaaccccgccagcggcgccctgagccccctgcccagacccaacggcaccgccaacaccaccaagaacctggtggtgaccgccgagatgtgctgctactgcttcgacgtgctgtactgccacctgtacggcttcccccagcccagactgcccagattcaccaacgacccctaccccctgttcgtgacctggaagaccggcagagacaagagactgagaggctgcatcggcaccttcagcgccatgaacctgcacagcggcctgagagagtacaccctgaccagcgccctgaaggacagcagattcccccccctgaccagagaggagctgcccaagctgttctgcagcgtgagcctgctgaccaacttcgaggacgccagcgactacctggactgggaggtgggcgtgcacggcatcagaatcgagttcatcaacgagaagggcgtgaagagaaccgccacctacctgcccgaggtggccaaggagcaggactgggaccagatccagaccatcgacagcctgctgagaaagggcggcttcaaggcccccatcaccagcgagttcagaaagaccatcaagctgaccagatacagaagcgagaaggtgaccatcagctacgccgagtacatcgccagcagacagcactgcttccagaacggcaccctgcacgccccccccctgtacaaccactacagctag

SEQ ID NO: 17838 - DNA, 933 bp, Artificial Sequence; identical to SEQ ID NO: 17837
  Description of Artificial Sequence: Synthetic coding sequence

SEQ ID NO: 17839 - DNA, 1728 bp, Artificial Sequence
  Description of Artificial Sequence: Synthetic coding sequence
atggacttccccaccatcagcagaagccccagcggcccccccgccatggacctggagggccccagagacatcctggtgcccagcgaggacctgacccccgacagccagtgggaccccatgcccggcggccccggcagcctgagcagaatggagctggacgagagcagcctgcaggagctggtgcagcagttcgaggccctgcccggcgacctggtgggccccagccccggcggcgccccctgccccctgcacatcgccaccggccacggcctggccagccaggagatcgccgacgcccacggcctgctgagcgccgaggccggcagagacgacctgctgggcctgctgcactgcgaggagtgcccccccagccagaccggccccgaggagcccctggagcccgcccccagactgctgcagccccccgaggaccccgacgaggacagcgacagccccgagtgggtggagggcgccagcgccgagcaggagggcagcagaagcagcagcagcagccccgagccctggctggagaccgtgcccctggtgacccccgaggagccccccgccggcgcccagagccccgagaccctggccagctaccccgccccccaggaggtgcccggcccctgcgaccacgaggacctgctggacggcgtgatcttcggcgccagatacctgggcagcacccagctggtgagcgagagaaacccccccaccagcaccagaatggcccaggccagagaggccatggacagagtgaaggcccccgacggcgagacccagcccatgaccgaggtggacctgttcgtgagcaccaagagaatcaaggtgctgaccgccgacagccaggaggccatgatggaccacgccctgcacaccatcagctacaccgccgacatcggctgcgtgctggtgctgatggccagaagaagactggccagaagacccgccccccaggaccacggcagaagactgtacaagatgctgtgccacgtgttctacgccgaggacgcccagctgatcgcccaggccatcggccaggccttcgccgccgcctacagccagttcctgagagagagcggcatcgaccccagccaggtgggcgtgcaccccagccccggcgcctgccacctgcacaacggcgacctggaccacttcagcaacagcgacaactgcagagaggtgcacctggagaagagaagaggcgagggcctgggcgtggccctggtggagagcggctggggcagcctgctgcccaccgccgtgatcgccaacctgctgcacggcggccccgccgagagaagcggcgccctgagcatcggcgacagactgaccgccatcaacggcaccagcctggtgggcctgcccctggccgcctgccaggccgccgtgagagagaccaagagccagaccagcgtgaccctgagcatcgtgcactgcccccccgtgaccaccgccatcatccacagaccccacgccagagagcagctgggcttctgcgtggaggacggcatcatctgcagcctgctgagaggcggcatcgccgagagaggcggcatcagagtgggccacagaatcatcgagatcaacggccagagcgtggtggccaccccccacgccagaatcatcgagctgctgaccgaggcctacggcgaggtgcacatcaagaccatgcccgccgccacctacagactgctgaccggccaggagcagcccgtgtacctgtag

SEQ ID NO: 17840 - DNA, 2013 bp, Artificial Sequence
  Description of Artificial Sequence: Synthetic coding sequence
atgatcgccagctgcctgtgctacctgctgctgcccgccaccagactgttcagagccctgagcgacgccttcttcacctgcagaaagaacgtgctgctggccaacagcagcagcccccaggtggagggcgacttcgccatggcccccagaggccccgagcaggaggagtgcgagggcctgctgcagcagtggagagaggagggcctgagccaggtgctgagcaccgccagcgagggccccctgatcgacaagggcctggcccagagcagcctggccctgctgatggacaaccccggcgaggagaacgccgccagcgaggacagatggagcagcagacagctgagcgacctgagagccgccgagaacctggacgagcccttccccgagatgctgggcgaggagcccctgctggaggtggagggcgtggagggcagcatgtgggccgccatccccatgcagagcgagccccagtacgccgactgcgccgccctgcccgtgggcgccctggccaccgagcagtgggaggaggaccccgccgtgctggcctggagcatcgcccccgagcccgtgccccaggaggaggccagcatctggcccttcgagggcctgggccagctgcagccccccgccgtggagatcccctaccacgagatcctgtggagagagtgggaggacttcagcacccagcccgacgcccagggcctgaaggccggcgacggcccccagttccagttcaccctgatgagctacaacatcctggcccaggacctgatgcagcagagcagcgagctgtacctgcactgccaccccgacatcctgaactggaactacagattcgtgaacctgatgcaggagttccagcactgggaccccgacatcctgtgcctgcaggaggtgcaggaggaccactactgggagcagctggagcccagcctgagaatgatgggcttcacctgcttctacaagagaagaaccggctgcaagaccgacggctgcgccgtgtgctacaagcccaccagattcagactgctgtgcgccagccccgtggagtacttcagacccggcctggagctgctgaacagagacaacgtgggcctggtgctgctgctgcagcccctggtgcccgagggcctgggccaggtgagcgtggcccccctgtgcgtggccaacacccacatcctgtacaaccccagaagaggcgacgtgaagctggcccagatggccatcctgctggccgaggtggacaaggtggccagactgagcgacggcagccactgccccatcatcctgtgcggcgacctgaacagcgtgcccgacagccccctgtacaacttcatcagagacggcgagctgcagtaccacggcatgcccgcctggaaggtgagcggccaggaggacttcagccaccagctgtaccagagaaagctgcaggcccccctgtggcccagcagcctgggcatcaccgactgctgccagtacgtgaccagctgccaccccaagagaagcgagagaagaaagtacggcagagacttcctgctgagattcagattctgcagcatcgcctgccagagacccgtgggcctggtgctgatggagggcgtgaccgacaccaagcccgagagacccgccggctgggccgagagcgtgctggaggaggacgccagcgagctggagcccgccttcagcagaaccgtgggcaccatccagcactgcctgcacctgaccagcgtgtacacccacttcctgccccagagaggcagacccgaggtgaccaccatgcccctgggcctgggcatgaccgtggactacatcttcttcagcgccgagagctgcgagaacggcaacagaaccgaccacagactgtacagagacggcaccctgaagctgctgggcagactgagcctgctgagcgaggagatcctgtgggccgccaacggcctgcccaaccccttctgcagcagcgaccacctgtgcctgctggccagcttcggcatggaggtgaccgccccctag

SEQ ID NO: 17841 - DNA, 789 bp, Artificial Sequence
  Description of Artificial Sequence: Synthetic coding sequence
atgttcccccaccacagcagaagcctgggcagagactggaccaccccctgggagaacctgcagagatgctgctggaacagacacatcagcagctgcatgagatggcccggccactacagcagagccccctacccctacttcagcagcagacacttcagcctgaactggagacccccctgcctgttcgagagcagaacccagttccagtactgcaactggagacccgacaacctgagccagaccagcctgatccacctgagcagctacgtgatgaacgccgagggcgacgagcccagcagcaagagaagaaagcaccagggcgtgatcaagagaaactgggagtacatctgcagccacgacaaggagaagaccaagatcctgggcgacaagaacgtggaccccaagtgcgaggacagcgagaacaagttcgacttcagcgtgatgagctacaacatcctgagccaggacctgctggaggacaacagccacctgtacagacactgcagaagacccgtgctgcactggagcttcagattccccaacatcctgaaggagatcaagcacttcgacgccgacgtgctgtgcctgcaggaggtgcaggaggaccactacggcgccgagatcagacccagcctggagagcctgggcaccatgcagctgttcttcttcttcttcttcttcgagaccggcagccacagcgtggcccagctggagtgcagcggcaccatcatggcccactacagcctgaacctgctgggcagcagcaaccccctgatcagcgccagctag

SEQ ID NO: 17842 - DNA, 1128 bp, Artificial Sequence
  Description of Artificial Sequence: Synthetic coding sequence
atgagctacaacatcctgagccaggacctgctggaggacaacagccacctgtacagacactgcagaagacccgtgctgcactggagcttcagattccccaacatcctgaaggagatcaagcacttcgacgccgacgtgctgtgcctgcaggaggtgcaggaggaccactacggcgccgagatcagacccagcctggagagcctgggctaccactgcgagtacaagatgagaaccggcagaaagcccgacggctgcgccatctgcttcaagcacagcaagttcagcctgctgagcgtgaaccccgtggagttcttcagacccgacatcagcctgctggacagagacaacgtgggcctggtgctgctgctgcagcccaagatcccctacgccgcctgccccgccatctgcgtggccaacacccacctgctgtacaaccccagaagaggcgacatcaagctgacccagctggccatgctgctggccgagatcagcagcgtggcccaccagaaggacggcagcttctgccccatcgtgatgtgcggcgacttcaacagcgtgcccggcagccccctgtacagcttcatcaaggagggcaagctgaactacgagggcctgcccatcggcaaggtgagcggccaggagcagagcagcagaggccagagaatcctgagcatccccatctggccccccaacctgggcatcagccagaactgcgtgtacgaggtgcagcaggtgcccaaggtggagaagaccgacagcgacctgacccagacccagctgaagcagaccgaggtgctggtgaccgccgagaagctgagcagcaacctgcagcaccacttcagcctgagcagcgtgtacagccactacttccccgacaccggcatccccgaggtgaccacctgccacagcagaagcgccatcaccgtggactacatcttctacagcgccgagaaggaggacgtggccggccaccccggcgccgaggtggccctggtgggcggcctgaagctgctggccagactgagcctgctgaccgagcaggacctgtggaccgtgaacggcctgcccaacgagaacaacagcagcgaccacctgcccctgctggccaagttcagactggagctgtag

SEQ ID NO: 17843 - DNA, 1635 bp, Artificial Sequence
  Description of Artificial Sequence: Synthetic coding sequence
atggaggcctggagatgcgtgagaaagggctacggccactgcgtggtgggcagaggcagataccccatgttcccccaccacagcagaagcctgggcagagactggaccaccccctgggagaacctgcagagatgctgctggaacagacacatcagcagctgcatgagatggcccggccactacagcagagccccctacccctacttcagcagcagacacttcagcctgaactggagacccccctgcctgttcgagagcagaacccagttccagtactgcaactggagacccgacaacctgagccagaccagcctgatccacctgagcagctacgtgatgaacgccgagggcgacgagcccagcagcaagagaagaaagcaccagggcgtgatcaagagaaactgggagtacatctgcagccacgacaaggagaagaccaagatcctgggcgacaagaacgtggaccccaagtgcgaggacagcgagaacaagttcgacttcagcgtgatgagctacaacatcctgagccaggacctgctggaggacaacagccacctgtacagacactgcagaagacccgtgctgcactggagcttcagattccccaacatcctgaaggagatcaagcacttcgacgccgacgtgctgtgcctgcaggaggtgcaggaggaccactacggcgccgagatcagacccagcctggagagcctgggctaccactgcgagtacaagatgagaaccggcagaaagcccgacggctgcgccatctgcttcaagcacagcaagttcagcctgctgagcgtgaaccccgtggagttcttcagacccgacatcagcctgctggacagagacaacgtgggcctggtgctgctgctgcagcccaagatcccctacgccgcctgccccgccatctgcgtggccaacacccacctgctgtacaaccccagaagaggcgacatcaagctgacccagctggccatgctgctggccgagatcagcagcgtggcccaccagaaggacggcagcttctgccccatcgtgatgtgcggcgacttcaacagcgtgcccggcagccccctgtacagcttcatcaaggagggcaagctgaactacgagggcctgcccatcggcaaggtgagcggccaggagcagagcagcagaggccagagaatcctgagcatccccatctggccccccaacctgggcatcagccagaactgcgtgtacgaggtgcagcaggtgcccaaggtggagaagaccgacagcgacctgacccagacccagctgaagcagaccgaggtgctggtgaccgccgagaagctgagcagcaacctgcagcaccacttcagcctgagcagcgtgtacagccactacttccccgacaccggcatccccgaggtgaccacctgccacagcagaagcgccatcaccgtggactacatcttctacagcgccgagaaggaggacgtggccggccaccccggcgccgaggtggccctggtgggcggcctgaagctgctggccagactgagcctgctgaccgagcaggacctgtggaccgtgaacggcctgcccaacgagaacaacagcagcgaccacctgcccctgctggccaagttcagactggagctgtag

SEQ ID NO: 17844 - DNA, 639 bp, Artificial Sequence
  Description of Artificial Sequence: Synthetic coding sequence
atgagctacaacatcctgagccaggacctgctggaggacaacagccacctgtacagacactgcagaagacccgtgctgcactggagcttcagattccccaacatcctgaaggagatcaagcacttcgacgccgacgtgctgtgcctgcaggaggtgcaggaggaccactacggcgccgagatcagacccagcctggagagcctgggctaccactgcgagtacaagatgagaaccggcagaaagcccgacggctgcgccatctgcttcaagcacagcaagttcagcctgctgagcgtgaaccccgtggagttcttcagacccgacatcagcctgctggacagagacaacgtgggcctggtgctgctgctgcagcccaagatcccctacgccgcctgccccgccatctgcgtggccaacacccacctgctgtacaaccccagaagaggcgacatcaagctgacccagctggccatgctgctggccgagatcagcagcgtggcccaccagaaggacggcagcttctgccccatcgtgatgtgcggcgacttcaacagcgtgcccggcagccccctgtacagcttcatcaaggagggcaagctgaactacgagggcctgcccatcggcaagaccgtgatctag

SEQ ID NO: 17845 - DNA, 1257 bp, Artificial Sequence
  Description of Artificial Sequence: Synthetic coding sequence
atggagggcgtgatcaagagaaactgggagtacatctgcagccacgacaaggagaagaccaagatcctgggcgacaagaacgtggaccccaagtgcgaggacagcgagaacaagttcgacttcagcgtgatgagctacaacatcctgagccaggacctgctggaggacaacagccacctgtacagacactgcagaagacccgtgctgcactggagcttcagattccccaacatcctgaaggagatcaagcacttcgacgccgacgtgctgtgcctgcaggaggtgcaggaggaccactacggcgccgagatcagacccagcctggagagcctgggctaccactgcgagtacaagatgagaaccggcagaaagcccgacggctgcgccatctgcttcaagcacagcaagttcagcctgctgagcgtgaaccccgtggagttcttcagacccgacatcagcctgctggacagagacaacgtgggcctggtgctgctgctgcagcccaagatcccctacgccgcctgccccgccatctgcgtggccaacacccacctgctgtacaaccccagaagaggcgacatcaagctgacccagctggccatgctgctggccgagatcagcagcgtggcccaccagaaggacggcagcttctgccccatcgtgatgtgcggcgacttcaacagcgtgcccggcagccccctgtacagcttcatcaaggagggcaagctgaactacgagggcctgcccatcggcaaggtgagcggccaggagcagagcagcagaggccagagaatcctgagcatccccatctggccccccaacctgggcatcagccagaactgcgtgtacgaggtgcagcaggtgcccaaggtggagaagaccgacagcgacctgacccagacccagctgaagcagaccgaggtgctggtgaccgccgagaagctgagcagcaacctgcagcaccacttcagcctgagcagcgtgtacagccactacttccccgacaccggcatccccgaggtgaccacctgccacagcagaagcgccatcaccgtggactacatcttctacagcgccgagaaggaggacgtggccggccaccccggcgccgaggtggccctggtgggcggcctgaagctgctggccagactgagcctgctgaccgagcaggacctgtggaccgtgaacggcctgcccaacgagaacaacagcagcgaccacctgcccctgctggccaagttcagactggagctgtag

SEQ ID NO: 17846 - DNA, 1128 bp, Artificial Sequence; identical to SEQ ID NO: 17842
  Description of Artificial Sequence: Synthetic coding sequence

SEQ ID NO: 17847 - DNA, 2520 bp, Artificial Sequence
  Description of Artificial Sequence: Synthetic coding sequence
atgagcgccggcgacggcctgagaagaggcaagagcgccagatgcggcctgaccttcagcgtgggcagattcttcagatggatggtggacaccagaatcagcgtgagaatccacgagtacgccgccatcagcctgaccgcctgcatggagaacctggtggaggagatcagagccagagtgatggccagccacagccccgacggcggcggcgccggcggcggcgaggtgagcgccgaggccctggagatggtgatcaacaacgacgccgagctgtggggcgtgctgcagccctacgagcacctgatctgcggcaagaacgccaacggcgtgctgagcctgcccgcctacttcagcccctacaacggcggcagcctgggccacgacgagagagccgacgcctacgcccagctggagctgagaaccctggagcagagcctgctggccacctgcgtgggcagcatcagcgagctgagcgacctggtgagcagagccatgcaccacatgcagggcagacaccccctgtgccccggcgccagccccgccagacaggccagacagcccccccagcccatcacctggagccccgacgccctgcacaccctgtactacttcctgagatgcccccagatggagagcatggagaaccccaacctggacccccccagaatgaccctgaacaacgagagacccttcatgctgctgccccccctgatggagtggatgagagtggccatcacctacgccgagcacagaagaagcctgaccgtggacagcggcgacatcagacaggccgccagactgctgctgcccggcctggactgcgagcccagacagctgaagcccgagcactgcttcagcagcttcagaagactggacgccagagccgccaccgagaagttcaaccaggacctgggcttcagaatgctgaactgcggcagaaccgacctgatcaaccaggccatcgaggccctgggccccgacggcgtgaacaccatggacgaccagggcatgacccccctgatgtacgcctgcgccgccggcgacgaggccatggtgcagatgctgatcgacgccggcgccaacctggacatccaggtgcccagcaacagccccagacaccccagcatccaccccgacagcagacactggaccagcctgaccttcgccgtgctgcacggccacatcagcgtggtgcagctgctgctggacgccggcgcccacgtggagggcagcgccgtgaacggcggcgaggacagctacgccgagacccccctgcagctggccagcgccgccggcaactacgagctggtgagcctgctgctgagcagaggcgccgaccccctgctgagcatgctggaggcccacggcatgggcagcagcctgcacgaggacatgaactgcttcagccacagcgccgcccacggccacagaaacgtgctgagaaagctgctgacccagccccagcaggccaaggccgacgtgctgagcctggaggagatcctggccgagggcgtggaggagagcgacgccagcagccagggcagcggcagcgagggccccgtgagactgagcagaaccagaaccaaggccctgcaggaggccatgtactacagcgccgagcacggctacgtggacatcaccatggagctgagagccctgggcgtgccctggaagctgcacatctggatcgagagcctgagaaccagcttcagccagagcagatacagcgtggtgcagagcctgctgagagacttcagcagcatcagagaggaggagtacaacgaggagctggtgaccgagggcctgcagctgatgttcgacatcctgaagaccagcaagaacgacagcgtgatccagcagctggccaccatcttcacccactgctacggcagcagccccatccccagcatccccgagatcagaaagaccctgcccgccagactggacccccacttcctgaacaacaaggagatgagcgacgtgaccttcctggtggagggcaagctgttctacgcccacaaggtgctgctggtgaccgccagcaacagattcaagaccctgatgaccaacaagagcgagcaggacggcgacagcagcaagaccatcgagatcagcgacatgaagtaccacatcttccagatgatgatgcagtacctgtactacggcggcaccgagagcatggagatccccaccaccgacatcctggagctgctgagcgccgccagcctgttccagctggacgccctgcagagacactgcgagatcctgtgcagccagaccctgagcatggagagcgccgtgaacacctacaagtacgccaagatccacaacgcccccgagctggccctgttctgcgagggcttcttcctgaagcacatgaaggccctgctggagcaggacgccttcagacagctgatctacggcagaagcagcaaggtgcagggcctggaccccctgcaggacctgcagaacaccctggccgagagagtgcacagcgtgtacatcaccagcagagtgtag

SEQ ID NO: 17848 - DNA, 3078 bp, Artificial Sequence
  Description of Artificial Sequence: Synthetic coding sequence
atggccggcacctacagcagcaccctgaagaccctggaggacctgaccctggacagcggctacggcgccggcgacagctgcagaagcctgagcctgagcagcagcaagagcaacagccaggccctgaacagcagcgcccagcagcacagaggcgccgcctggtggtgctacagcggcagcatgaacagcagacacaacagctgggacaccgtgaacaccgtgctgcccgaggaccccgaggtggccgacctgttcagcagatgccccagactgcccgagctggaggagttcccctggaccgagggcgacgtggccagagtgctgagaaagggcgccggcggcagaagactgccccagttcagcgccgaggccgtgagaagactggccggcctgctgagaagagccctgatcagagtggccagagaggcccagagactgagcgtgctgcacgccaagtgcaccagattcgaggtgcagagcgccgtgagactggtgcacagctgggccctggccgagagctgcgccctggccgccgtgaaggccctgagcctgtacagcatgagcgccggcgacggcctgagaagaggcaagagcgccagatgcggcctgaccttcagcgtgggcagattcttcagatggatggtggacaccagaatcagcgtgagaatccacgagtacgccgccatcagcctgaccgcctgcatggagaacctggtggaggagatcagagccagagtgatggccagccacagccccgacggcggcggcgccggcggcggcgaggtgagcgccgaggccctggagatggtgatcaacaacgacgccgagctgtggggcgtgctgcagccctacgagcacctgatctgcggcaagaacgccaacggcgtgctgagcctgcccgcctacttcagcccctacaacggcggcagcctgggccacgacgagagagccgacgcctacgcccagctggagctgagaaccctggagcagagcctgctggccacctgcgtgggcagcatcagcgagctgagcgacctggtgagcagagccatgcaccacatgcagggcagacaccccctgtgccccggcgccagccccgccagacaggccagacagcccccccagcccatcacctggagccccgacgccctgcacaccctgtactacttcctgagatgcccccagatggagagcatggagaaccccaacctggacccccccagaatgaccctgaacaacgagagacccttcatgctgctgccccccctgatggagtggatgagagtggccatcacctacgccgagcacagaagaagcctgaccgtggacagcggcgacatcagacaggccgccagactgctgctgcccggcctggactgcgagcccagacagctgaagcccgagcactgcttcagcagcttcagaagactggacgccagagccgccaccgagaagttcaaccaggacctgggcttcagaatgctgaactgcggcagaaccgacctgatcaaccaggccatcgaggccctgggccccgacggcgtgaacaccatggacgaccagggcatgacccccctgatgtacgcctgcgccgccggcgacgaggccatggtgcagatgctgatcgacgccggcgccaacctggacatccaggtgcccagcaacagccccagacaccccagcatccaccccgacagcagacactggaccagcctgaccttcgccgtgctgcacggccacatcagcgtggtgcagctgctgctggacgccggcgcccacgtggagggcagcgccgtgaacggcggcgaggacagctacgccgagacccccctgcagctggccagcgccgccggcaactacgagctggtgagcctgctgctgagcagaggcgccgaccccctgctgagcatgctggaggcccacggcatgggcagcagcctgcacgaggacatgaactgcttcagccacagcgccgcccacggccacagaaacgtgctgagaaagctgctgacccagccccagcaggccaaggccgacgtgctgagcctggaggagatcctggccgagggcgtggaggagagcgacgccagcagccagggcagcggcagcgagggccccgtgagactgagcagaaccagaaccaaggccctgcaggaggccatgtactacagcgccgagcacggctacgtggacatcaccatggagctgagagccctgggcgtgccctggaagctgcacatctggatcgagagcctgagaaccagcttcagccagagcagatacagcgtggtgcagagcctgctgagagacttcagcagcatcagagaggaggagtacaacgaggagctggtgaccgagggcctgcagctgatgttcgacatcctgaagaccagcaagaacgacagcgtgatccagcagctggccaccatcttcacccactgctacggcagcagccccatccccagcatccccgagatcagaaagaccctgcccgccagactggacccccacttcctgaacaacaaggagatgagcgacgtgaccttcctggtggagggcaagctgttctacgcccacaaggtgctgctggtgaccgccagcaacagattcaagaccctgatgaccaacaagagcgagcaggacggcgacagcagcaagaccatcgagatcagcgacatgaagtaccacatcttccagatgatgatgcagtacctgtactacggcggcaccgagagcatggagatccccaccaccgacatcctggagctgctgagcgccgccagcctgttccagctggacgccctgcagagacactgcgagatcctgtgcagccagaccctgagcatggagagcgccgtgaacacctacaagtacgccaagatccacaacgcccccgagctggccctgttctgcgagggcttcttcctgaagcacatgaaggccctgctggagcaggacgccttcagacagctgatctacggcagaagcagcaaggtgcagggcctggaccccctgcaggacctgcagaacaccctggccgagagagtgcacagcgtgtacatcaccagcagagtgtag

SEQ ID NO: 17849 - DNA, 126 bp, Artificial Sequence
  Description of Artificial Sequence: Synthetic coding sequence
atgcaggaggagctggcctgggagaccgacggcctgtgggacgagtgcgccagccccgtgtgcctggtgagacccctgaccaacccccccgacctgggcaagctgagaggccaggaccccctgtag

SEQ ID NO: 17850 - DNA, 414 bp, Artificial Sequence
  Description of Artificial Sequence: Synthetic coding sequence
atgcaggagctgatcggcagaagagtgaacaccagagccagaaaccacgtgggcagagtggccctgcactgggccgccggcgccggccacgagcaggccgtgagactgctgctggagcacgaggccgccgtggacgaggaggacgccgtgggcgccctgaccgaggagggcaacaccgccctgcacctggccgccggcagaggccacatggccgtgctgcagagactggtggacatcggcctggacctggaggagcagaacgccgagggcctgaccgccctgcacagcgccgccggcggcagccaccccgactgcgtgcagctgctgctgagagccggcagcaccgtgaacgccctgacccaggtggccagacccagccaggactgcggcagactgctggccgccgagccctag

SEQ ID NO: 17851 - DNA, 1473 bp, Artificial Sequence
  Description of Artificial Sequence: Synthetic coding sequence
atgcaggaggagctggcctgggagaccgacggcctgctgcccctggagagacagctgcacgaggccgccagacagaacaacgtgggcagaatgcaggagctgatcggcagaagagtgaacaccagagccagaaaccacgtgggcagagtggccctgcactgggccgccggcgccggccacgagcaggccgtgagactgctgctggagcacgaggccgccgtggacgaggaggacgccgtgggcgccctgaccgaggccagactgtgcttcggcatgaacgccctgctgctgagcgcctggttcggccacctgagaatcctgcagatcctggtgaacagcggcgccaagatccactgcgagagcaaggacggcctgaccctgctgcactgcgccgcccagaagggccacgtgcccgtgctggccttcatcatggaggacctggaggacgtggccctggaccacgtggacaagctgggcagaaccgccttccacagagccgccgagcacggccagctggacgccctggacttcctggtgggcagcggctgcgaccacaacgtgaaggacaaggagggcaacaccgccctgcacctggccgccggcagaggccacatggccgtgctgcagagactggtggacatcggcctggacctggaggagcagaacgccgagggcctgaccgccctgcacagcgccgccggcggcagccaccccgactgcgtgcagctgctgctgagagccggcagcaccgtgaacgccctgacccagaagaacctgagctgcctgcactacgccgccctgagcggcagcgaggacgtgagcagagtgctgatccacgccggcggctgcgccaacgtggtggaccaccagggcgccagccccctgcacctggccgtgagacacaacttccccgccctggtgagactgctgatcaacagcgacagcgacgtgaacgccgtggacaacagacagcagacccccctgcacctggccgccgagcacgcctggcaggacatcgccgacatgctgctgatcgccggcgtggacctgaacctgagagacaaggaccaccccagcgaccccagcggcaagagcctgagcttcaagcaggaccacagacaggagacccagcagctgagaagcgtgctgtggagactggccagcagatacctgcagcccagagagtggaagaagctggcctacagctgggagttcaccgaggcccacgtggacgccatcgagcagcagtggaccggcaccagaagctaccaggagcacggccacagaatgctgctgatctggctgcacggcgtggccaccgccggcgagaaccccagcaaggccctgttcgagggcctggtggccatcggcagaagagacctggccggctggagcaccatggccagaagccagctgaccgccaccagcgccagcagagtgcagatgatcctggtgccccagccccccgagtag

SEQ ID NO: 17852 - DNA, 1569 bp, Artificial Sequence
  Description of Artificial Sequence: Synthetic coding sequence
atgcaggaggagctggcctgggagaccgacggcctgctgcccctggagagacagctgcacgaggccgccagacagaacaacgtgggcagaatgcaggagctgatcggcagaagagtgaacaccagagccagaaaccacgtgggcagagtggccctgcactgggccgccggcgccggccacgagcaggccgtgagactgctgctggagcacgaggccgccgtggacgaggaggacgccgtgggcgccctgaccgaggccagactgtgcttcggcatgaacgccctgctgctgagcgcctggttcggccacctgagaatcctgcagatcctggtgaacagcggcgccaagatccactgcgagagcaaggacggcctgaccctgctgcactgcgccgcccagaagggccacgtgcccgtgctggccttcatcatggaggacctggaggacgtggccctggaccacgtggacaagctgggcagaaccgccttccacagagccgccgagcacggccagctggacgccctggacttcctggtgggcagcggctgcgaccacaacgtgaaggacaaggagggcaacaccgccctgcacctggccgccggcagaggccacatggccgtgctgcagagactggtggacatcggcctggacctggaggagcagaacgccgagggcctgaccgccctgcacagcgccgccggcggcagccaccccgactgcgtgcagctgctgctgagagccggcagcaccgtgaacgccctgacccagaagaacctgagctgcctgcactacgccgccctgagcggcagcgaggacgtgagcagagtgctgatccacgccggcggctgcgccaacgtggtggaccaccagggcgccagccccctgcacctggccgtgagacacaacttccccgccctggtgagactgctgatcaacagcgacagcgacgtgaacgccgtggacaacagacagcagacccccctgcacctggccgccgagcacgcctggcaggacatcgccgacatgctgctgatcgccggcgtggacctgaacctgagagacaagcagggcaagaccgccctggccgtggccgtgagaagcaaccacgtgagcctggtggacatgatcatcaaggccgacagattctacagatgggagaaggaccaccccagcgaccccagcggcaagagcctgagcttcaagcaggaccacagacaggagacccagcagctgagaagcgtgctgtggagactggccagcagatacctgcagcccagagagtggaagaagctggcctacagctgggagttcaccgaggcccacgtggacgccatcgagcagcagtggaccggcaccagaagctaccaggagcacggccacagaatgctgctgatctggctgcacggcgtggccaccgccggcgagaaccccagcaaggccctgttcgagggcctggtggccatcggcagaagagacctggccggctggagcaccatggccagaagccagctgaccgccaccagcgccagcagagtgcagatgatcctggtgccccagccccccgagtag

SEQ ID NO: 17853 - DNA, 1545 bp, Artificial Sequence
  Description of Artificial Sequence: Synthetic coding sequence
atgcaggaggagctggcctgggagaccgacggcctgctgcccctggagagacagctgcacgaggccgccagacagaacaacgtgggcagaatgcaggagctgatcggcagaagagtgaacaccagagccagaaaccacgtgggcagagtggccctgcactgggccgccggcgccggccacgagcaggccgtgagactgctgctggagcacgaggccgccgtggacgaggaggacgccgtgggcgccctgaccgaggccagactgtgcttcggcatgaacgccctgctgctgagcgcctggttcggccacctgagaatcctgcagatcctggtgaacagcggcgccaagatccactgcgagagcaaggacggcctgaccctgctgcactgcgccgcccagaagggccacgtgcccgtgctggccttcatcatggaggacctggaggacgtggccctggaccacgtggacaagctgggcagaaccgccttccacagagccgccgagcacggccagctggacgccctggacttcctggtgggcagcggctgcgaccacaacgtgaaggacaaggagggcaacaccgccctgcacctggccgccggcagaggccacatggccgtgctgcagagactggtggacatcggcctggacctggaggagcagaacgccgagggcctgaccgccctgcacagcgccgccggcggcagccaccccgactgcgtgcagctgctgctgagagccggcagcaccgtgaacgccctgacccagaagaacctgagctgcctgcactacgccgccctgagcggcagcgaggacgtgagcagagtgctgatccacgccggcggctgcgccaacgtggtggaccaccagggcgccagccccctgcacctggccgtgagacacaacttccccgccctggtgagactgctgatcaacagcgacagcgacgtgaacgccgtggacaacagacagcagacccccctgcacctggccgccgagcacgcctggcaggacatcgccgacatgctgctgatcgccggcgtggacctgaacctgagagacaagcagggcaagaccgccctggccgtggccgtgagaagcaaccacgtgagcctggtggacatgatcatcaaggccgacagattctacagatgggagaaggaccaccccagcgaccccagcggcaagagcctgagcttcaagcaggaccacagacaggagacccagcagctgagaagcgtgctgtggagactggccagcagatacctgcagcccagagagtggaagaagctggcctacagctgggagttcaccgaggcccacgtggacgccatcgagcagcagtggaccggcaccagaagctaccaggagcacggccacagaatgctgctgatctggctgcacggcgtggccaccgccggcgagaaccccagcaaggccctgttcgagggcctggtggccatcggcagaagagacctggccgagaacatcagaaagaaggccaacgccgcccccagcgcccccagaagatgcaccgccatgtag

SEQ ID NO: 17854 - DNA, 1200 bp, Artificial Sequence
  Description of Artificial Sequence: Synthetic coding sequence
atgaacgccctgctgctgagcgcctggttcggccacctgagaatcctgcagatcctggtgaacagcggcgccaagatccactgcgagagcaaggacggcctgaccctgctgcactgcgccgcccagaagggccacgtgcccgtgctggccttcatcatggaggacctggaggacgtggccctggaccacgtggacaagctgggcagaaccgccttccacagagccgccgagcacggccagctggacgccctggacttcctggtgggcagcggctgcgaccacaacgtgaaggacaaggagggcaacaccgccctgcacctggccgccggcagaggccacatggccgtgctgcagagactggtggacatcggcctggacctggaggagcagaacgccgagggcctgaccgccctgcacagcgccgccggcggcagccaccccgactgcgtgcagctgctgctgagagccggcagcaccgtgaacgccctgacccagaagaacctgagctgcctgcactacgccgccctgagcggcagcgaggacgtgagcagagtgctgatccacgccggcggctgcgccaacgtggtggaccaccagggcgccagccccctgcacctggccgtgagacacaacttccccgccctggtgagactgctgatcaacagcgacagcgacgtgaacgccgtggacaacagacagcagacccccctgcacctggccgccgagcacgcctggcaggacatcgccgacatgctgctgatcgccggcgtggacctgaacctgagagacaaggaccaccccagcgaccccagcggcaagagcctgagcttcaagcaggaccacagacaggagacccagcagctgagaagcgtgctgtggagactggccagcagatacctgcagcccagagagtggaagaagctggcctacagctgggagttcaccgaggcccacgtggacgccatcgagcagcagtggaccggcaccagaagctaccaggagcacggccacagaatgctgctgatctggctgcacggcgtggccaccgccggcgagaaccccagcaaggccctgttcgagggcctggtggccatcggcagaagagacctggccggctggagcaccatggccagaagccagctgaccgccaccagcgccagcagagtgcagatgatcctggtgccccagccccccgagtag

SEQ ID NO: 17855 - DNA, 546 bp, Artificial Sequence
  Description of Artificial Sequence: Synthetic coding sequence
atgaacgccctgctgctgagcgcctggttcggccacctgagaatcctgcagatcctggtgaacagcggcgccaagatccactgcgagagcaaggacggcctgaccctgctgcactgcgccgcccagaagggccacgtgcccgtgctggccttcatcatggaggacctggaggacgtggccctggaccacgtggacaagctgggcagaaccgccttccacagagccgccgagcacggccagctggacgccctggacttcctggtgggcagcggctgcgaccacaacgtgaaggacaaggagggcaacaccgccctgcacctggccgccggcagaggccacatggccgtgctgcagagactggtggacatcggcctggacctggaggagcagaacgccgagggcctgaccgccctgcacagcgccgccggcggcagccaccccgactgcgtgcagctgctgctgagagccggcagcaccgtgaacgccctgacccaggtggccagacccagccaggactgcggcagactgctggccgccgagccctag

SEQ ID NO: 17856 - DNA, 270 bp, Artificial Sequence
  Description of Artificial Sequence: Synthetic coding sequence
atgctgggcggcctgggcaagctggccgccgagggcctggcccacagaaccgagaaggccaccgagggcgccatccacgccgtggaggaggtggtgaaggaggtggtgggccacgccaaggagaccggcgagaaggccatcgccgaggccatcaagaaggcccaggagagcggcgacaagaagatgaaggagatcaccgagaccgtgaccaacaccgtgaccaacgccatcacccacgccgccgagagcctggacaagctgggccagtag

SEQ ID NO: 17857 - DNA, 3270 bp, Artificial Sequence
  Description of Artificial Sequence: Synthetic coding sequence
atgggcaacaccaccaccaagttcagaaaggccctgatcaacggcgacgagaacctggcctgccagatctacgagaacaacccccagctgaaggagagcctggaccccaacaccagctacggcgagccctaccagcacaacacccccctgcactacgccgccagacacggcatgaacaagatcctgggcaccttcctgggcagagacggcaaccccaacaagagaaacgtgcacaacgagaccagcatgcacctgctgtgcatgggcccccagatcatgatcagcgagggcgccctgcaccccagactggccagacccaccgaggacgacttcagaagagccgactgcctgcagatgatcctgaagtggaagggcgccaagctggaccagggcgagtacgagagagccgccatcgacgccgtggacaacaagaagaacacccccctgcactacgccgccgccagcggcatgaaggcctgcgtggagctgctggtgaagcacggcggcgacctgttcgccgagaacgagaacaaggacaccccctgcgactgcgccgagaagcagcaccacaaggacctggccctgaacctggagagccagatggtgttcagcagagaccccgaggccgaggagatcgaggccgagtacgccgccctggacaagagagagccctacgagggcctgagaccccaggacctgagaagactgaaggacatgctgatcgtggagaccgccgacatgctgcaggcccccctgttcaccgccgaggccctgctgagagcccacgactgggacagagagaagctgctggaggcctggatgagcaaccccgagaactgctgccagagaagcggcgtgcagatgcccacccccccccccagcggctacaacgcctgggacaccctgcccagccccagaacccccagaaccaccagaagcagcgtgaccagccccgacgagatcagcctgagccccggcgacctggacaccagcctgtgcgacatctgcatgtgcagcatcagcgtgttcgaggaccccgtggacatgccctgcggccacgacttctgcagaggctgctgggagagcttcctgaacctgaagatccaggagggcgaggcccacaacatcttctgccccgcctacgactgcttccagctggtgcccgtggacatcatcgagagcgtggtgagcaaggagatggacaagagatacctgcagttcgacatcaaggccttcgtggagaacaaccccgccatcaagtggtgccccacccccggctgcgacagagccgtgagactgaccaagcagggcagcaacaccagcggcagcgacaccctgagcttccccctgctgagagcccccgccgtggactgcggcaagggccacctgttctgctgggagtgcctgggcgaggcccacgagccctgcgactgccagacctggaagaactggctgcagaagatcaccgagatgaagcccgaggagctggtgggcgtgagcgaggcctacgaggacgccgccaactgcctgtggctgctgaccaacagcaagccctgcgccaactgcaagagccccatccagaagaacgagggctgcaaccacatgcagtgcgccaagtgcaagtacgacttctgctggatctgcctggaggagtggaagaagcacagcagcagcaccggcggctactacagatgcaccagatacgaggtgatccagcacgtggaggagcagagcaaggagatgaccgtggaggccgagaagaagcacaagagattccaggagctggacagattcatgcactactacaccagattcaagaaccacgagcacagctaccagctggagcagagactgctgaagaccgccaaggagaagatggagcagctgagcagagccctgaaggagaccgagggcggctgccccgacaccaccttcatcgaggacgccgtgcacgtgctgctgaagaccagaagaatcctgaagtgcagctacccctacggcttcttcctggagcccaagagcaccaagaaggagatcttcgagctgatgcagaccgacctggagatggtgaccgaggacctggcccagaaggtgaacagaccctacctgagaacccccagacacaagatcatcaaggccgcctgcctggtgcagcagaagagacaggagttcctggccagcgtggccagaggcgtggcccccgccgacagccccgaggcccccagaagaagcttcgccggcggcacctgggactgggagtacctgggcttcgccagccccgaggagtacgccgagttccagtacagaagaagacacagacagagaagaagaggcgacgtgcacagcctgctgagcaacccccccgaccccgacgagcccagcgagagcaccctggacatccccgagggcggcagcagcagcagaagacccggcaccagcgtggtgagcagcgccagcatgagcgtgctgcacagcagcagcctgagagactacacccccgccagcagaagcgagaaccaggacagcctgcaggccctgagcagcctggacgaggacgaccccaacatcctgctggccatccagctgagcctgcaggagagcggcctggccctggacgaggagaccagagacttcctgagcaacgaggccagcctgggcgccatcggcaccagcctgcccagcagactggacagcgtgcccagaaacaccgacagccccagagccgccctgagcagcagcgagctgctggagctgggcgacagcctgatgagactgggcgccgagaacgaccccttcagcaccgacaccctgagcagccaccccctgagcgaggccagaagcgacttctgccccagcagcagcgaccccgacagcgccggccaggaccccaacatcaacgacaacctgctgggcaacatcatggcctggttccacgacatgaacccccagagcatcgccctgatcccccccgccaccaccgagatcagcgccgacagccagctgccctgcatcaaggacggcagcgagggcgtgaaggacgtggagctggtgctgcccgaggacagcatgttcgaggacgccagcgtgagcgagggcagaggcacccagatcgaggagaaccccctggaggagaacatcctggccggcgaggccgccagccaggccggcgacagcggcaacgaggccgccaacagaggcgacggcagcgacgtgagcagccagaccccccagaccagcagcgactggctggagcaggtgcacctggtgtag

SEQ ID NO: 17858 - DNA, 405 bp, Artificial Sequence
  Description of Artificial Sequence: Synthetic coding sequence
atgggcaacaccaccaccaagttcagaaaggccctgatcaacggcgacgagaacctggcctgccagatctacgagaacaacccccagctgaaggagagcctggaccccaacaccagctacggcgagccctaccagcacaacacccccctgcactacgccgccagacacggcatgaacaagatcctgggcaccttcctgggcagagacggcaaccccaacaagagaaacgtgcacaacgagaccagcatgcacctgctgtgcatgggcccccagatcatgatcagcgagggcgccctgcaccccagactggccagacccaccgaggacgacttcagaagagccgactgcctgcagatgatcctgaagtggaagggcgccaagctggaccagggcgagtacgagtag

SEQ ID NO: 17859 - DNA, 1947 bp, Artificial Sequence
  Description of Artificial Sequence: Synthetic coding sequence
atgctgtggcccagactggccgccgccgagtgggccgccctggcctgggagctgctgggcgccagcgtgctgctgatcgccgtgagatggctggtgagaagactgggccccagacccggcggcctgggcagaagcggcacccccgtgcccccccccagcgccgccgccgcccccgccagcggcgagatgaccatggacgccctgctggccagactgaagctgctgaaccccgacgacctgagagaggagatcgtgaaggccggcctgaagtgcggccccatcaccagcaccaccagattcatcttcgagaagaagctggcccaggccctgctggagcagggcggcagactgagcagcttctaccaccacgaggccggcgtgaccgccctgagccaggacccccagagaatcctgaagcccgccgagggcaaccccaccgaccaggccggcttcagcgaggacagagacttcggctacagcgtgggcctgaacccccccgaggaggaggccgtgaccagcaagacctgcagcgtgccccccagcgacaccgacacctacagagccggcgccaccgccagcaaggagccccccctgtactacggcgtgtgccccgtgtacgaggacgtgcccgccagaaacgagagaatctacgtgtacgagaacaagaaggaggccctgcaggccgtgaagatgatcaagggcagcagattcaaggccttcagcaccagagaggacgccgagaagttcgccagaggcatctgcgactacttccccagccccagcaagaccagcctgcccctgagccccgtgaagaccgcccccctgttcagcaacgacagactgaaggacggcctgtgcctgagcgagagcgagaccgtgaacaaggagagagccaacagctacaagaaccccagaacccaggacctgaccgccaagctgagaaaggccgtggagaagggcgaggaggacaccttcagcgacctgatctggagcaaccccagatacctgatcggcagcggcgacaaccccaccatcgtgcaggagggctgcagatacaacgtgatgcacgtggccgccaaggagaaccaggccagcatctgccagctgaccctggacgtgctggagaaccccgacttcatgagactgatgtaccccgacgacgacgaggccatgctgcagaagagaatcagatacgtggtggacctgtacctgaacacccccgacaagatgggctacgacacccccctgcacttcgcctgcaagttcggcaacgccgacgtggtgaacgtgctgagcagccaccacctgatcgtgaagaacagcagaaacaagtacgacaagacccccgaggacgtgatctgcgagagaagcaagaacaagagcgtggagctgaaggagagaatcagagagtacctgaagggccactactacgtgcccctgctgagagccgaggagaccagcagccccgtgatcggcgagctgtggagccccgaccagaccgccgaggccagccacgtgagcagatacggcggcagccccagagaccccgtgctgaccctgagagccttcgccggccccctgagccccgccaaggccgaggacttcagaaagctgtggaagaccccccccagagagaaggccggcttcctgcaccacgtgaagaagagcgaccccgagagaggcttcgagagagtgggcagagagctggcccacgagctgggctacccctgggtggagtactgggagttcctgggctgcttcgtggacctgagcagccaggagggcctgcagagactggaggagtacctgacccagcaggagatcggcaagaaggcccagcaggagaccggcgagagagaggccagctgcagagacaaggccaccaccagcgtggagatgagattccacagaatcgaccaggccggcctggagctgctgaccagctag

SEQ ID NO: 17860 - DNA, 2817 bp, Artificial Sequence
  Description of Artificial Sequence: Synthetic coding sequence
atgctgtggcccagactggccgccgccgagtgggccgccctggcctgggagctgctgggcgccagcgtgctgctgatcgccgtgagatggctggtgagaagactgggccccagacccggcggcctgggcagaagcggcacccccgtgcccccccccagcgccgccgccgcccccgccagcggcgagatgaccatggacgccctgctggccagactgaagctgctgaaccccgacgacctgagagaggagatcgtgaaggccggcctgaagtgcggccccatcaccagcaccaccagattcatcttcgagaagaagctggcccaggccctgctggagcagggcggcagactgagcagcttctaccaccacgaggccggcgtgaccgccctgagccaggacccccagagaatcctgaagcccgccgagggcaaccccaccgaccaggccggcttcagcgaggacagagacttcggctacagcgtgggcctgaacccccccgaggaggaggccgtgaccagcaagacctgcagcgtgccccccagcgacaccgacacctacagagccggcgccaccgccagcaaggagccccccctgtactacggcgtgtgccccgtgtacgaggacgtgcccgccagaaacgagagaatctacgtgtacgagaacaagaaggaggccctgcaggccgtgaagatgatcaagggcagcagattcaaggccttcagcaccagagaggacgccgagaagttcgccagaggcatctgcgactacttccccagccccagcaagaccagcctgcccctgagccccgtgaagaccgcccccctgttcagcaacgacagactgaaggacggcctgtgcctgagcgagagcgagaccgtgaacaaggagagagccaacagctacaagaaccccagaacccaggacctgaccgccaagctgagaaaggccgtggagaagggcgaggaggacaccttcagcgacctgatctggagcaaccccagatacctgatcggcagcggcgacaaccccaccatcgtgcaggagggctgcagatacaacgtgatgcacgtggccgccaaggagaaccaggccagcatctgccagctgaccctggacgtgctggagaaccccgacttcatgagactgatgtaccccgacgacgacgaggccatgctgcagaagagaatcagatacgtggtggacctgtacctgaacacccccgacaagatgggctacgacacccccctgcacttcgcctgcaagttcggcaacgccgacgtggtgaacgtgctgagcagccaccacctgatcgtgaagaacagcagaaacaagtacgacaagacccccgaggacgtgatctgcgagagaagcaagaacaagagcgtggagctgaaggagagaatcagagagtacctgaagggccactactacgtgcccctgctgagagccgaggagaccagcagccccgtgatcggcgagctgtggagccccgaccagaccgccgaggccagccacgtgagcagatacggcggcagccccagagaccccgtgctgaccctgagagccttcgccggccccctgagccccgccaaggccgaggacttcagaaagctgtggaagaccccccccagagagaaggccggcttcctgcaccacgtgaagaagagcgaccccgagagaggcttcgagagagtgggcagagagctggcccacgagctgggctacccctgggtggagtactgggagttcctgggctgcttcgtggacctgagcagccaggagggcctgcagagactggaggagtacctgacccagcaggagatcggcaagaaggcccagcaggagaccggcgagagagaggccagctgcagagacaaggccaccaccagcggcagcaacagcatcagcgtgagagccttcctggacgaggacgacatgagcctggaggagatcaagaacagacagaacgccgccagaaacaacagcccccccaccgtgggcgccttcggccacaccagatgcagcgccttccccctggagcaggaggccgacctgatcgaggccgccgagcccggcggcccccacagcagcagaaacggcctgtgccaccccctgaaccacagcagaaccctggccggcaagagacccaaggcccccagaggcgaggaggcccacctgccccccgtgagcgacctgaccgtggagttcgacaagctgaacctgcagaacatcggcagaagcgtgagcaagacccccgacgagagcaccaagaccaaggaccagatcctgaccagcagaatcaacgccgtggagagagacctgctggagcccagccccgccgaccagctgggcaacggccacagaagaaccgagagcgagatgagcgccagaatcgccaagatgagcctgagccccagcagccccagacacgaggaccagctggaggtgaccagagagcccgccagaagactgttcctgttcggcgaggagcccagcaagctggaccaggacgtgctggccgccctggagtgcgccgacgtggacccccaccagttccccgccgtgcacagatggaagagcgccgtgctgtgctacagccccagcgacagacagagctggcccagccccgccgtgaagggcagattcaagagccagctgcccgacctgagcggcccccacagctacagccccggcagaaacagcgtggccggcagcaaccccgccaagcccggcctgggcagccccggcagatacagccccgtgcacggcagccagctgagaagaatggccagactggccgagctggccgccctgtag

SEQ ID NO: 17861 - DNA, 2631 bp, Artificial Sequence
  Description of Artificial Sequence: Synthetic coding sequence
atgaccatggacgccctgctggccagactgaagctgctgaaccccgacgacctgagagaggagatcgtgaaggccggcctgaagtgcggccccatcaccagcaccaccagattcatcttcgagaagaagctggcccaggccctgctggagcagggcggcagactgagcagcttctaccaccacgaggccggcgtgaccgccctgagccaggacccccagagaatcctgaagcccgccgagggcaaccccaccgaccaggccggcttcagcgaggacagagacttcggctacagcgtgggcctgaacccccccgaggaggaggccgtgaccagcaagacctgcagcgtgccccccagcgacaccgacacctacagagccggcgccaccgccagcaaggagccccccctgtactacggcgtgtgccccgtgtacgaggacgtgcccgccagaaacgagagaatctacgtgtacgagaacaagaaggaggccctgcaggccgtgaagatgatcaagggcagcagattcaaggccttcagcaccagagaggacgccgagaagttcgccagaggcatctgcgactacttccccagccccagcaagaccagcctgcccctgagccccgtgaagaccgcccccctgttcagcaacgacagactgaaggacggcctgtgcctgagcgagagcgagaccgtgaacaaggagagagccaacagctacaagaaccccagaacccaggacctgaccgccaagctgagaaaggccgtggagaagggcgaggaggacaccttcagcgacctgatctggagcaaccccagatacctgatcggcagcggcgacaaccccaccatcgtgcaggagggctgcagatacaacgtgatgcacgtggccgccaaggagaaccaggccagcatctgccagctgaccctggacgtgctggagaaccccgacttcatgagactgatgtaccccgacgacgacgaggccatgctgcagaagagaatcagatacgtggtggacctgtacctgaacacccccgacaagatgggctacgacacccccctgcacttcgcctgcaagttcggcaacgccgacgtggtgaacgtgctgagcagccaccacctgatcgtgaagaacagcagaaacaagtacgacaagacccccgaggacgtgatctgcgagagaagcaagaacaagagcgtggagctgaaggagagaatcagagagtacctgaagggccactactacgtgcccctgctgagagccgaggagaccagcagccccgtgatcggcgagctgtggagccccgaccagaccgccgaggccagccacgtgagcagatacggcggcagccccagagaccccgtgctgaccctgagagccttcgccggccccctgagccccgccaaggccgaggacttcagaaagctgtggaagaccccccccagagagaaggccggcttcctgcaccacgtgaagaagagcgaccccgagagaggcttcgagagagtgggcagagagctggcccacgagctgggctacccctgggtggagtactgggagttcctgggctgcttcgtggacctgagcagccaggagggcctgcagagactggaggagtacctgacccagcaggagatcggcaagaaggcccagcaggagaccggcgagagagaggccagctgcagagacaaggccaccaccagcggcagcaacagcatcagcgtgagagccttcctggacgaggacgacatgagcctggaggagatcaagaacagacagaacgccgccagaaacaacagcccccccaccgtgggcgccttcggccacaccagatgcagcgccttccccctggagcaggaggccgacctgatcgaggccgccgagcccggcggcccccacagcagcagaaacggcctgtgccaccccctgaaccacagcagaaccctggccggcaagagacccaaggcccccagaggcgaggaggcccacctgccccccgtgagcgacctgaccgtggagttcgacaagctgaacctgcagaacatcggcagaagcgtgagcaagacccccgacgagagcaccaagaccaaggaccagatcctgaccagcagaatcaacgccgtggagagagacctgctggagcccagccccgccgaccagctgggcaacggccacagaagaaccgagagcgagatgagcgccagaatcgccaagatgagcctgagccccagcagccccagacacgaggaccagctggaggtgaccagagagcccgccagaagactgttcctgttcggcgaggagcccagcaagctggaccaggacgtgctggccgccctggagtgcgccgacgtggacccccaccagttccccgccgtgcacagatggaagagcgccgtgctgtgctacagccccagcgacagacagagctggcccagccccgccgtgaagggcagattcaagagccagctgcccgacctgagcggcccccacagctacagccccggcagaaacagcgtggccggcagcaaccccgccaagcccggcctgggcagccccggcagatacagccccgtgcacggcagccagctgagaagaatggccagactggccgagctggccgccctgtag

SEQ ID NO: 17862 - DNA, 2826 bp, Artificial Sequence
  Description of Artificial Sequence: Synthetic coding sequence
atgtaccagggcgagttcggcctgaacatgaagctgggctacggcaagttcagctggcccaccggcgagagctaccacggccagttctacagagaccactgccacggcctgggcacctacatgtggcccgacggcagcagcttcaccggcaccttctacctgagccacagagagggctacggcaccatgtacatgaagaccagactgttccagggcctgtacaaggccgaccagagattcggccccggcgtggagacctaccccgacggcagccaggacgtgggcctgtggttcagagagcagctgatcaagctgtgcacccagatccccagcggcttcagcctgctgagataccccgagttcagcagcttcatcacccacagccccgccagaatcagcctgagcgaggaggagaagaccgagtggggcctgcaggagggccaggaccccttcttctacgactacaagagattcctgctgaacgacaacctgaccctgccccccgagatgtacgtgtacagcaccaacagcgaccacctgcccatgaccagcagcttcagaaaggagctggacgccagaatcttcctgaacgagatcccccccttcgtggaggacggcgagccctggttcatcatcaacgagacccccctgctggtgaagatccagaagcagacctacaagttcagaaacaagcccgcccacaccagctggaacatgggcgccatcctggagggcaagagaagcggcttcgccccctgcggccccaaggagcagctgagcatggagatgatcctgaaggccgaggagggcaaccacgagtggatctgcagaatcctgaaggacaacttcgccagcgccgacgtggccgacgccaagggctacaccgtgctggccgccgccgccacccactgccacaacgacatcgtgaacctgctgctggactgcggcgccgacgtgaacaagtgcagcgacgagggcctgaccgccctgagcatgtgcttcctgctgcactaccccgcccagagcttcaagcccaacgtggccgagagaaccatccccgagccccaggagccccccaagttccccgtggtgcccatcctgagcagcagcttcatggacaccaacctggagagcctgtactacgaggtgaacgtgcccagccagggcagctacgagctgagacccccccccgcccccctgctgctgcccagagtgagcggcagccacgagggcggccacttccaggacaccggccagtgcggcggcagcatcgaccacagaagcagcagcctgaagggcgacagccccctggtgaagggcagcctgggccacgtggagagcggcctggaggacgtgctgggcaacaccgacagaggcagcctgtgcagcgccgagaccaagttcgagagcaacgtgtgcgtgtgcgacttcagcatcgagctgagccaggccatgctggagagaagcgcccagagccacagcctgctgaagatggccagccccagcccctgcaccagcagcttcgacaagggcaccatgagaagaatggccctgagcatgatcgagagaagaaagagatggagaaccatcaagctgctgctgagaagaggcgccgaccccaacctgtgctgcgtgcccatgcaggtgctgttcctggccgtgaaggccggcgacgtggacggcgtgagactgctgctggagcacggcgccagaaccgacatctgcttccccccccagctgagcaccctgacccccctgcacatcgccgccgccctgcccggcgaggagggcgtgcagatcgtggagctgctgctgcacgccatcaccgacgtggacgccaaggccagcgacgaggacgacacctacaagcccggcaagctggacctgctgcccagcagcctgaagctgagcaacgagcccggccccccccaggcctactacagcaccgacaccgccctgcccgaggagggcggcagaaccgccctgcacatggcctgcgagagagaggacgacaacaagtgcgccagagacatcgtgagactgctgctgagccacggcgccaaccccaacctgctgtggagcggccacagccccctgagcctgagcatcgccagcggcaacgagctggtggtgaaggagctgctgacccagggcgccgaccccaacctgcccctgaccaagggcctgggcagcgccctgtgcgtggcctgcgacctgacctacgagcaccagagaaacatggacagcaagctggccctgatcgacagactgatcagccacggcgccgacatcctgaagcccgtgatgctgagacagggcgagaaggaggccgtgggcaccgccgtggactacggctacttcagattcttccaggacagaagaatcgccagatgccccttccacaccctgatgcccgccgagagagagaccttcctggccagaaagagactgctggagtacatgggcctgcagctgagacaggccgtgttcgccaaggagagccagtgggaccccacctggctgtacctgtgcaagagagccgagctgatccccagccacagaatgaagaagaagggccccagcctgcccagaggcctggacgtgaaggagcagggccagatccccttcttcaagttctgctaccagtgcggcagaagcatcggcgtgagactgctgccctgccccagatgctacggcatcctgacctgcagcaagtactgcaagaccaaggcctggaccgagttccacaagaaggactgcggcgacctggtggccatcgtgacccagctggagcaggtgagcagaagaagagaggagttccagtag

SEQ ID NO: 17863 - DNA, 2154 bp, Artificial Sequence
  Description of Artificial Sequence: Synthetic coding sequence
atggagggcgcccacgccagcctgagcctggaggacgaggtgagcggcgccggcagcagacagagacccctggagggcaagggcggcgagacccccgccgccgaggagcccggcagcctgaagaactacgccgtgttcgccaccagagacgtgagcgccgcccccgagaaggaggaggaggaggccgagggccccctgagagcccaggacctgagagagagctacatccagctggtgcagggcgtgcaggagtggcaggacggctgcatgtaccagggcgagttcggcctgaacatgaagctgggctacggcaagttcagctggcccaccggcgagagctaccacggccagttctacagagaccactgccacggcctgggcacctacatgtggcccgacggcagcagcttcaccggcaccttctacctgagccacagagagggctacggcaccatgtacatgaagaccagactgttccagacccactgccacaacgacatcgtgaacctgctgctggactgcggcgccgacgtgaacaagtgcagcgacgagggcctgaccgccctgagcatgtgcttcctgctgcactaccccgcccagagcttcaagcccaacgtggccgagagaaccatccccgagccccaggagccccccaagttccccgtggtgcccatcctgagcagcagcttcatggacaccaacctggagagcctgtactacgaggtgaacgtgcccagccagggcagctacgagctgagacccccccccgcccccctgctgctgcccagagtgagcggcagccacgagggcggccacttccaggacaccggccagtgcggcggcagcatcgaccacagaagcagcagcctgaagggcgacagccccctggtgaagggcagcctgggccacgtggagagcggcctggaggacgtgctgggcaacaccgacagaggcagcctgtgcagcgccgagaccaagttcgagagcaacgtgtgcgtgtgcgacttcagcatcgagctgagccaggccatgctggagagaagcgcccagagccacagcctgctgaagatggccagccccagcccctgcaccagcagcttcgacaagggcaccatgagaagaatggccctgagcatgatcgagagaagaaagagatggagaaccatcaagctgctgctgagaagaggcgccgaccccaacctgtgctgcgtgcccatgcaggtgctgttcctggccgtgaaggccggcgacgtggacggcgtgagactgctgctggagcacggcgccagaaccgacatctgcttccccccccagctgagcaccctgacccccctgcacatcgccgccgccctgcccggcgaggagggcgtgcagatcgtggagctgctgctgcacgccatcaccgacgtggacgccaaggccagcgacgaggacgacacctacaagcccggcaaggtggtgaaggagctgctgacccagggcgccgaccccaacctgcccctgaccaagggcctgggcagcgccctgtgcgtggcctgcgacctgacctacgagcaccagagaaacatggacagcaagctggccctgatcgacagactgatcagccacggcgccgacatcctgaagcccgtgatgctgagacagggcgagaaggaggccgtgggcaccgccgtggactacggctacttcagattcttccaggacagaagaatcgccagatgccccttccacaccctgatgcccgccgagagagagaccttcctggccagaaagagactgctggagtacatgggcctgcagctgagacaggccgtgttcgccaaggagagccagtgggaccccacctggctgtacctgtgcaagagagccgagctgatccccagccacagaatgaagaagaagggccccagcctgcccagaggcctggacgtgaaggagcagggccagatccccttcttcaagttctgctaccagtgcggcagaagcatcggcgtgagactgctgccctgccccagatgctacggcatcctgacctgcagcaagtactgcaagaccaaggcctggaccgagttccacaagaaggactgcggcgacctggtggccatcgtgacccagctggagcaggtgagcagaagaagagaggagttccagtag

SEQ ID NO: 17864 - DNA, 2136 bp, Artificial Sequence
  Description of Artificial Sequence: Synthetic coding sequence
atgtaccagggcgagttcggcctgaacatgaagctgggctacggcaagttcagctggcccaccggcgagagctaccacggccagttctacagagaccactgccacggcctgggcacctacatgtggcccgacggcagcagcttcaccggcaccttctacctgagccacagagagggctacggcaccatgtacatgaagaccagactgttccagacccactgccacaacgacatcgtgaacctgctgctggactgcggcgccgacgtgaacaagtgcagcgacgagggcctgaccgccctgagcatgtgcttcctgctgcactaccccgcccagagcttcaagcccaacgtggccgagagaaccatccccgagccccaggagccccccaagttccccgtggtgcccatcctgagcagcagcttcatggacaccaacctggagagcctgtactacgaggtgaacgtgcccagccagggcagctacgagctgagacccccccccgcccccctgctgctgcccagagtgagcggcagccacgagggcggccacttccaggacaccggccagtgcggcggcagcatcgaccacagaagcagcagcctgaagggcgacagccccctggtgaagggcagcctgggccacgtggagagcggcctggaggacgtgctgggcaacaccgacagaggcagcctgtgcagcgccgagaccaagttcgagagcaacgtgtgcgtgtgcgacttcagcatcgagctgagccaggccatgctggagagaagcgcccagagccacagcctgctgaagatggccagccccagcccctgcaccagcagcttcgacaagggcaccatgagaagaatggccctgagcatgatcgagagaagaaagagatggagaaccatcaagctgctgctgagaagaggcgccgaccccaacctgtgctgcgtgcccatgcaggtgctgttcctggccgtgaaggccggcgacgtggacggcgtgagactgctgctggagcacggcgccagaaccgacatctgcttccccccccagctgagcaccctgacccccctgcacatcgccgccgccctgcccggcgaggagggcgtgcagatcgtggagctgctgctgcacgccatcaccgacgtggacgccaaggccagcgacgaggacgacacctacaagcccggcaagctggacctgctgcccagcagcctgaagctgagcaacgagcccggccccccccaggcctactacagcaccgacaccgccctgcccgaggagggcggcagaaccgccctgcacatggcctgcgagagagaggacgacaacaagtgcgccagagacatcgtgagactgctgctgagccacggcgccaaccccaacctgctgtggagcggccacagccccctgagcctgagcatcgccagcggcaacgagctggtggtgaaggagctgctgacccagggcgccgaccccaacctgcccctgaccaagggcctgggcagcgccctgtgcgtggcctgcgacctgacctacgagcaccagagaaacatggacagcaagctggccctgatcgacagactgatcagccacggcgccgacatcctgaagcccgtgatgctgagacagggcgagaaggaggccgtgggcaccgccgtggactacggctacttcagattcttccaggacagaagaatcgccagatgccccttccacaccctgatgcccgccgagagagagaccttcctggccagaaagagactgctggagtacatgggcctgcagctgagacaggccgtgttcgccaaggagagccagtgggaccccacctggctgtacctgtgcaagagagccgagctgatccccagccacagaatgaagaagaagggccccagcctgcccagaggcctggacgtgaaggagcagggccagatccccttcttcaagttctgctaccagtgcggcagaagcatcggcgtgagactgctgccctgccccagatgctacggcatcctgacctgcagcaagtactgcaagaccaaggcctggaccgagttccacaagaaggactgcggcgacctggtggccatcgtgacccagctggagcaggtgagcagaagaagagaggagttccagtag

SEQ ID NO: 17865 - DNA, 2826 bp, Artificial Sequence; identical to SEQ ID NO: 17862
  Description of Artificial Sequence: Synthetic coding sequence

SEQ ID NO: 17866 - DNA, 1320 bp, Artificial Sequence
  Description of Artificial Sequence: Synthetic coding sequence
atggagggcgcccacgccagcctgagcctggaggacgaggtgagcggcgccggcagcagacagagacccctggagggcaagggcggcgagacccccgccgccgaggagcccggcagcctgaagaactacgccgtgttcgccaccagagacgtgagcgccgcccccgagaaggaggaggaggaggccgagggccccctgagagcccaggacctgagagagagctacatccagctggtgcagggcgtgcaggagtggcaggacggctgcatgtaccagggcgagttcggcctgaacatgaagctgggctacggcaagttcagctggcccaccggcgagagctaccacggccagttctacagagaccactgccacggcctgggcacctacatgtggcccgacggcagcagcttcaccggcaccttctacctgagccacagagagggctacggcaccatgtacatgaagaccagactgttccagacccactgccacaacgacatcgtgaacctgctgctggactgcggcgccgacgtgaacaagtgcagcgacgagggcctgaccgccctgagcatgtgcttcctgctgcactaccccgcccagagcttcaagcccaacgtggccgagagaaccatccccgagccccaggagccccccaagttccccgtggtgcccatcctgagcagcagcttcatggacaccaacctggagagcctgtactacgaggtgaacgtgcccagccagggcagctacgagctgagacccccccccgcccccctgctgctgcccagagtgagcggcagccacgagggcggccacttccaggacaccggccagtgcggcggcagcatcgaccacagaagcagcagcctgaagggcgacagccccctggtgaagggcagcctgggccacgtggagagcggcctggaggacgtgctgggcaacaccgacagaggcagcctgtgcagcgccgagaccaagttcgagagcaacgtgtgcgtgtgcgacttcagcatcgagctgagccaggccatgctggagagaagcgcccagagccacagcctgctgaagatggccagccccagcccctgcaccagcagcttcgacaagggcaccatgagaagaatggccctgagcatgatcgagagaagaaagagatggagaaccatcaagctgctgctgagaagaggcgccgaccccaacctgtgctgcgtgcccatgcaggtgctgttcctggccgtgaaggccggcgacgtggacggcgtgagactgctgctggagcacggcgccagaaccgacatctgcttccccccccagtgctag

SEQ ID NO: 17867 - DNA, 225 bp, Artificial Sequence
  Description of Artificial Sequence: Synthetic coding sequence
atggagggcgcccacgccagcctgagcctggaggacgaggtgagcggcgccggcagcagacagagacccctggagggcaagggcggcgagacccccgccgccgaggagcccggcagcctgaagaactacgccgtgttcgccaccagagacgtgagcgccgcccccgagaaggaggaggaggaggccgagggccccctgagagcccaggacctgagagagagctag
